(12) United States Patent
Beigelman et al.

(10) Patent No.: US 6,528,640 B1
(45) Date of Patent: Mar. 4, 2003

(54) SYNTHETIC RIBONUCLEIC ACIDS WITH RNASE ACTIVITY

(75) Inventors: Leonid Beigelman, Broomfield, CO (US); Alex Burgin, Chula Vista, CA (US); Amber Beaudry, Broomfield, CO (US); Alexander Karpeisky, Lafayette, CO (US); Jasenka Matulic-Adamic, Boulder, CO (US); David Sweedler, Louisville, CO (US); Shawn Zinnen, Denver, CO (US)

(73) Assignee: Ribozyme Pharmaceuticals, incorporated, Boulder, CO (US)

( * ) Notice: Subject to any disclaimer, the term of this patent is extended or adjusted under 35 U.S.C. 154(b) by 0 days.

(21) Appl. No.: 09/474,432

(22) Filed: Dec. 29, 1999

Related U.S. Application Data

(63) Continuation-in-part of application No. 09/301,511, filed on Apr. 28, 1999, which is a continuation-in-part of application No. 09/186,675, filed on Nov. 4, 1998, now Pat. No. 6,127,535.
(60) Provisional application No. 60/083,727, filed on Apr. 29, 1998, and provisional application No. 60/064,866, filed on Nov. 5, 1997.

(51) Int. Cl.[7] ............................................. C07H 21/02
(52) U.S. Cl. ................ 536/25.1; 536/624.3; 536/24.31; 536/24.347; 536/23.1
(58) Field of Search ............................. 536/23.1, 25.1, 536/29.3, 24.31, 24.32

(56) References Cited

U.S. PATENT DOCUMENTS 6,127,535 A * 10/2000 Beigelman et al. ...... 536/26.26

FOREIGN PATENT DOCUMENTS

| WO | WO99/58665 A2 | * | 11/1999 |
| WO | WO00/20621 A1 | * | 4/2000 |
| WO | WO00/58473 A2 | * | 10/2000 |
| WO | WO01/16312 A2 | * | 3/2001 |
| WO | WO01/57058 A2 | * | 8/2001 |
| WO | WO01/64876 A2 | * | 9/2001 |
| WO | WO01/64877 A2 | * | 9/2001 |

OTHER PUBLICATIONS

U.S. patent application Ser. No. 09/167,705 A2, Schmidt et al., filed Oct. 6, 1998.*
U.S. patent application Ser. No. 60–127,607 P, Shimketts et al., filed Mar. 31, 1999.*
U.S. patent application Ser. No. 60–085,383 P, Sikes et al., filed May 14, 1998.*

* cited by examiner

*Primary Examiner*—Gary Geist
*Assistant Examiner*—L. E. Crane
(74) *Attorney, Agent, or Firm*—McDonnell Boehnen Hulbert & Berghoff

(57) ABSTRACT

Novel nucleotide triphosphates, methods of synthesis and process of incorporating these nucleotide triphosphates into oligonucleotides, and isolation of novel nucleic acid catalysts (e.g., ribozymes) are disclosed. Also, described are the use of novel enzymatic nucleic acid molecules to inhibit HER2/neu/ErbB2 gene expression and their applications in human therapy.

3 Claims, 21 Drawing Sheets

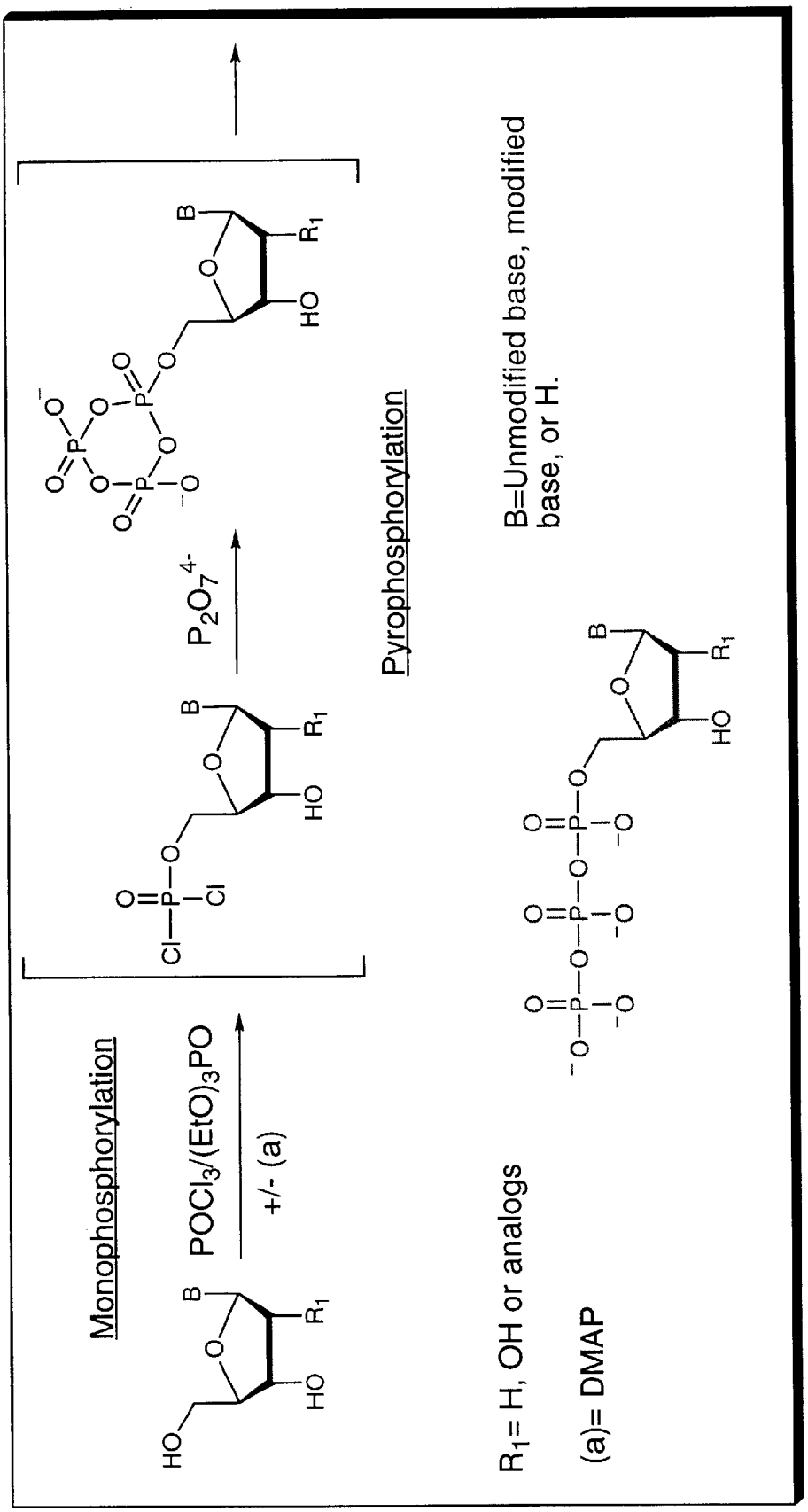
Figure 1: One-Pot Formation of Nucleoside-5'-triphosphates

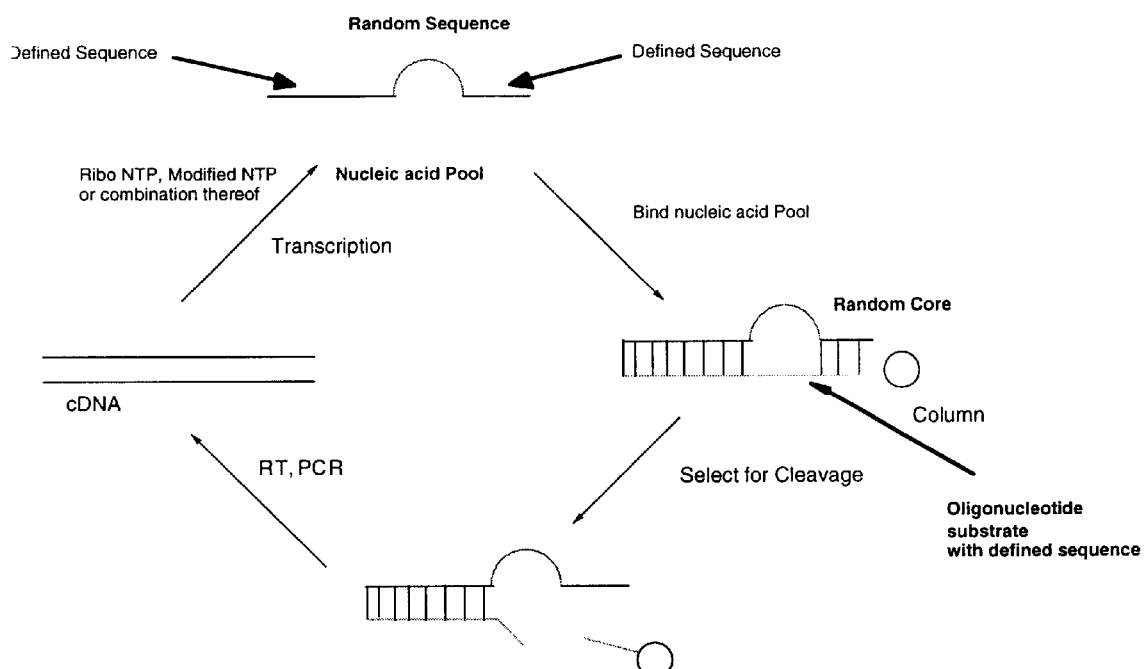
Figure 2. In Vitro Selection of Trans Acting Nucleic Acid Catalysts

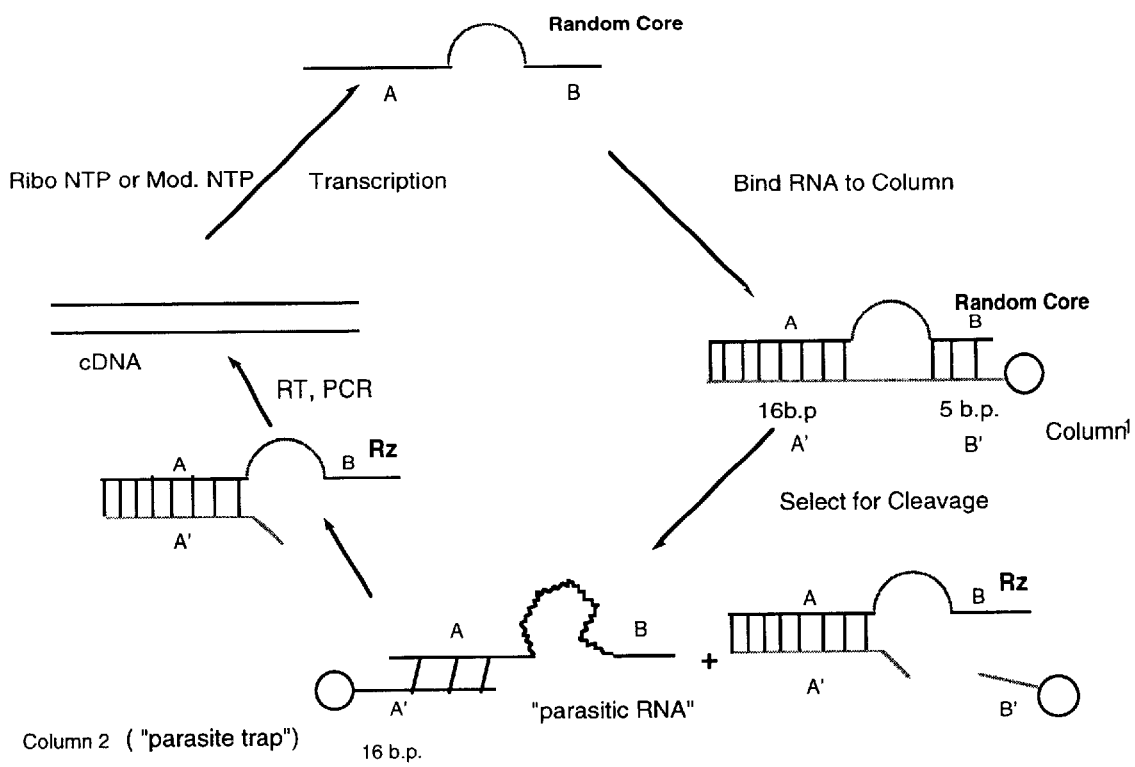
Figure 3. Removal of "parasitic RNA" using a Second Selection column

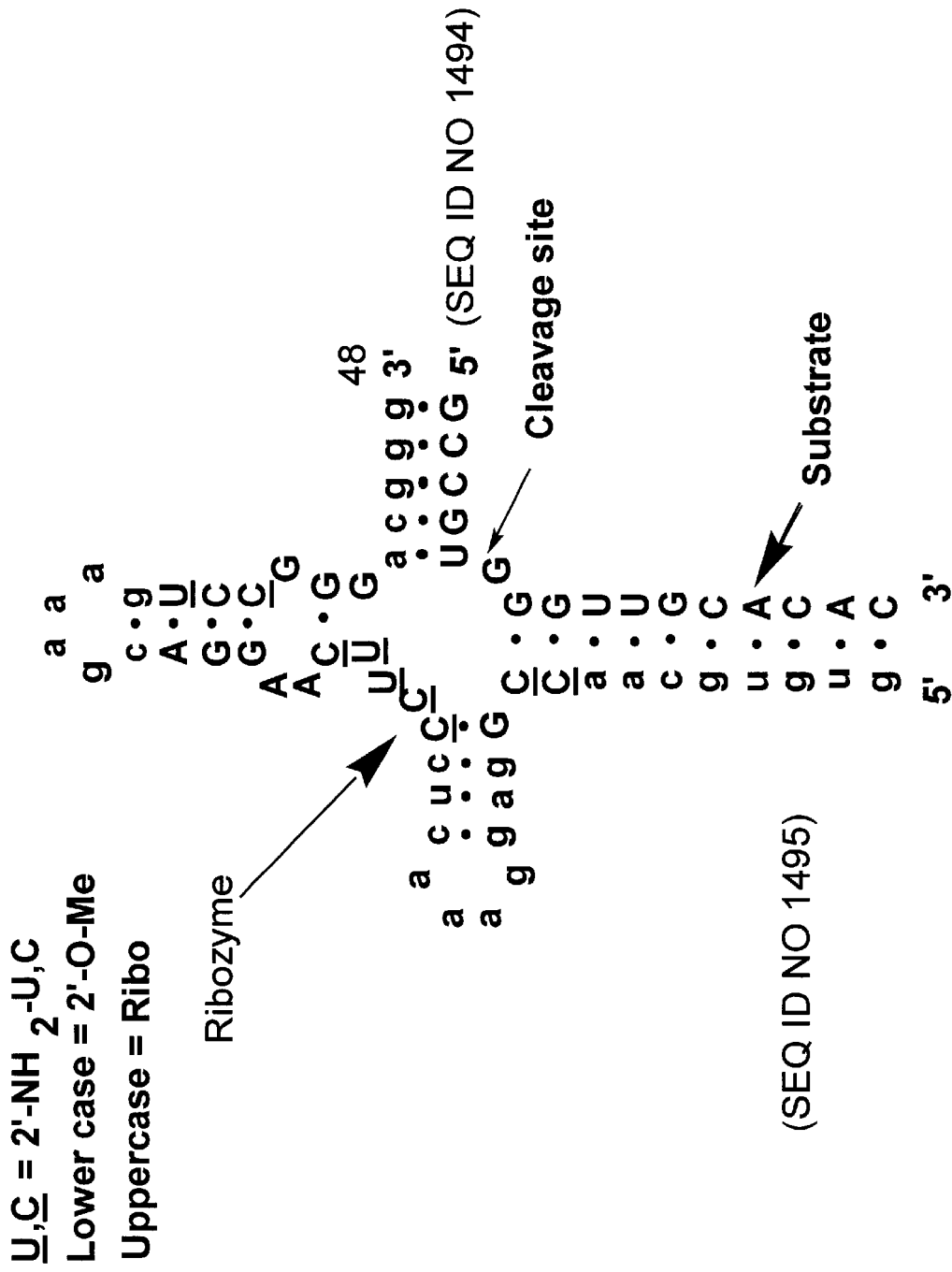
*Figure 4: 2'-O-Me Stabilization of a Class I (Amberzyme) Enzymatic Nucleic Acid Motif*

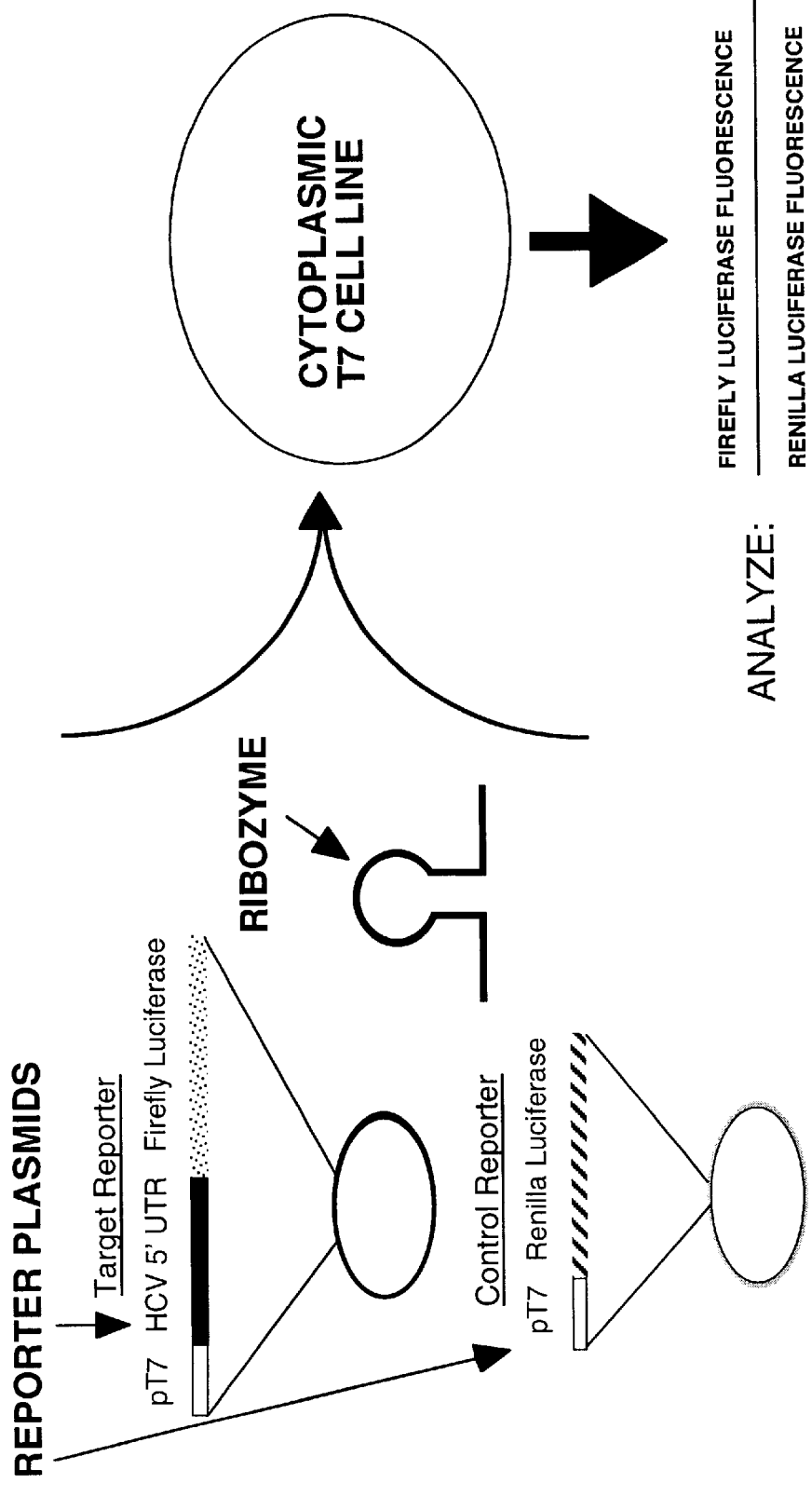
FIGURE 5. Dual Reporter System for Cytoplasmic HCV Target

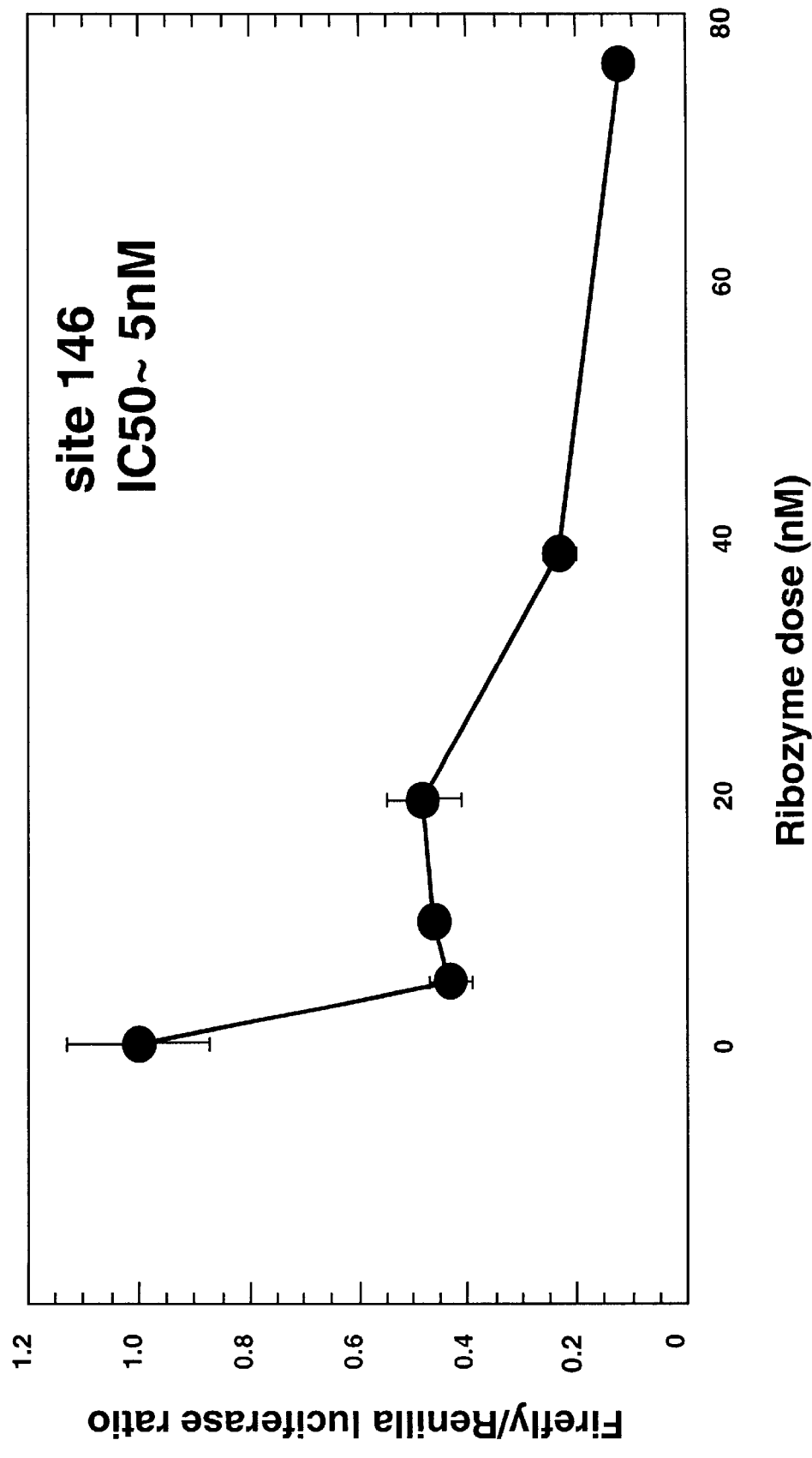
Figure 6. Dose-dependent inhibition of HCV-IRES mediated luciferase activity

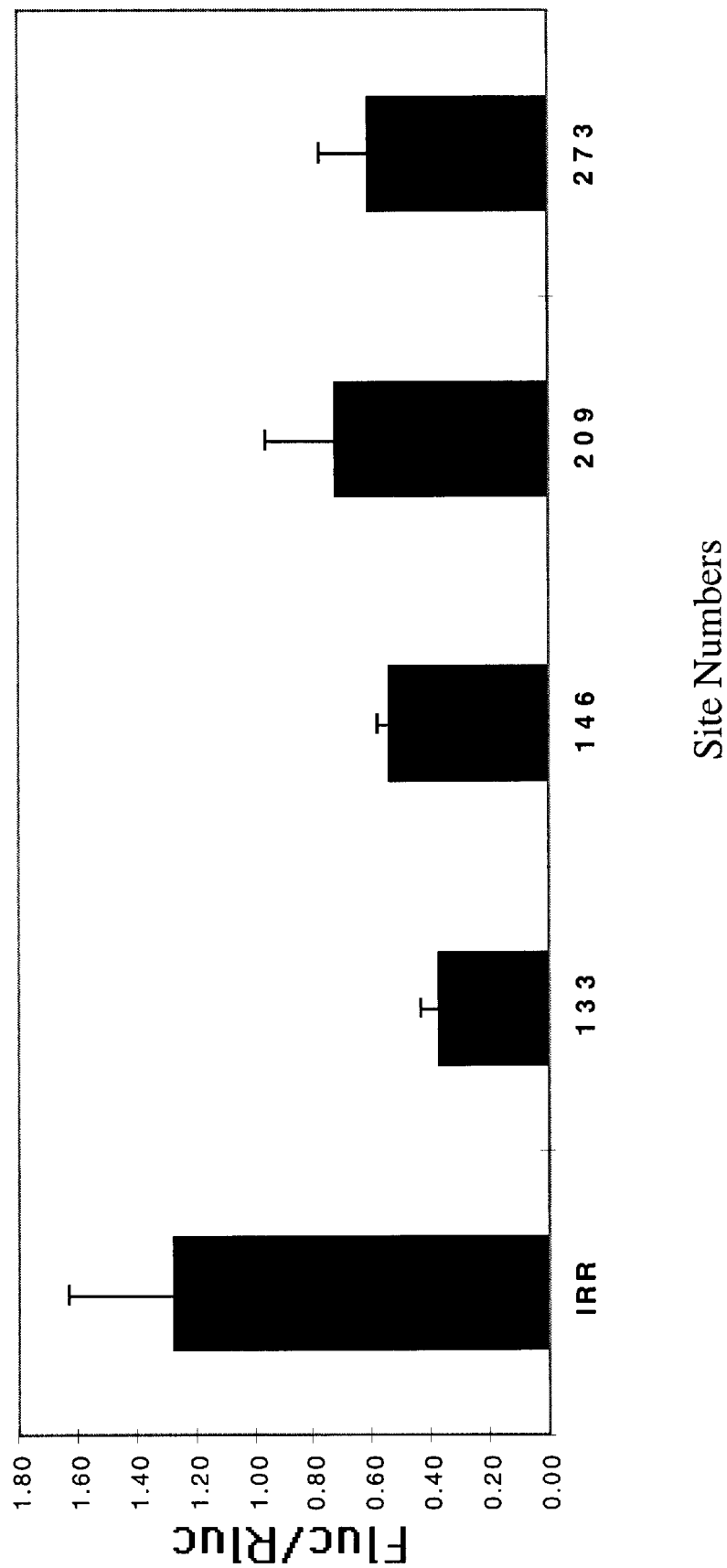

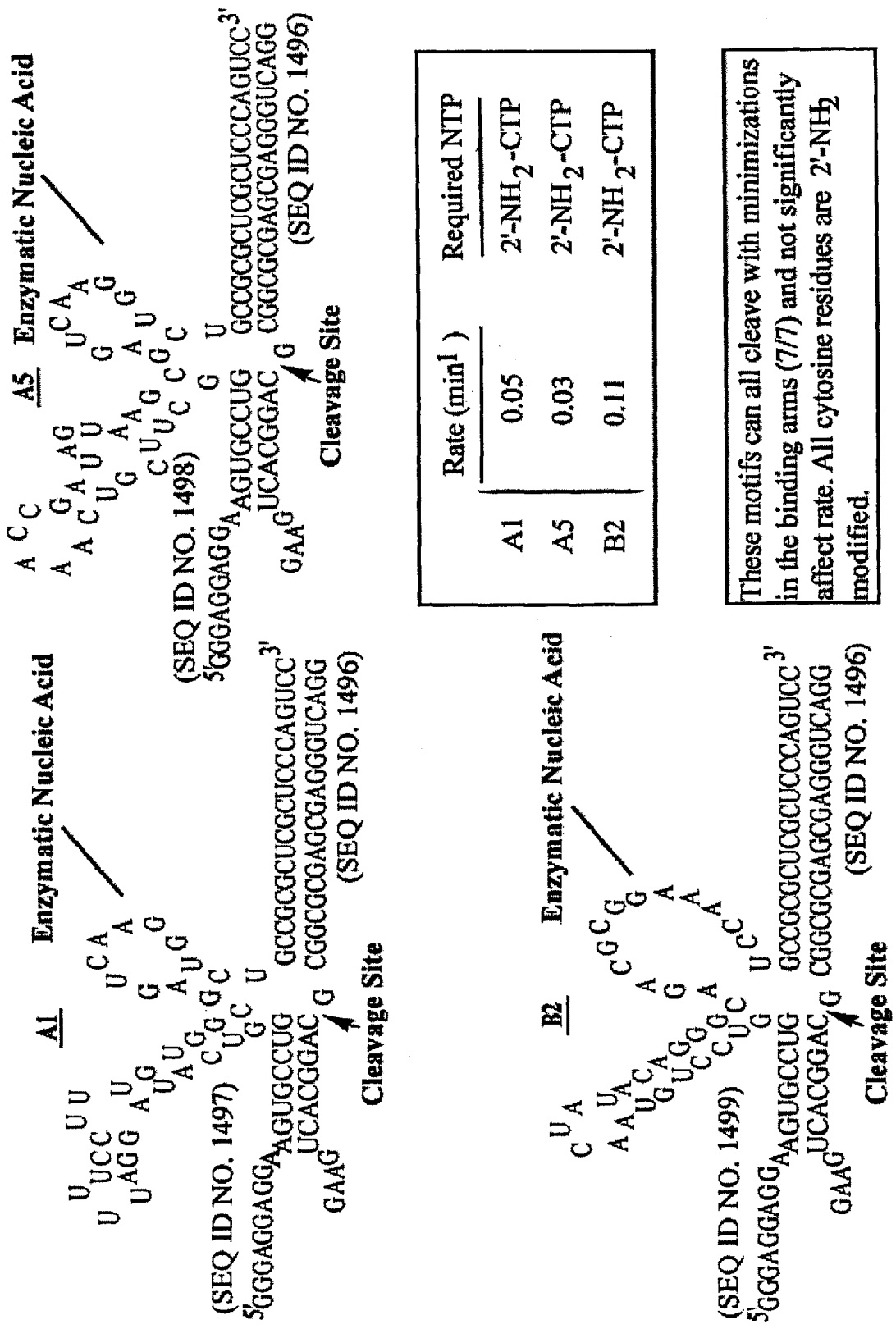
Figure 8a: Class II Enzymatic Nucleic Acid Motifs

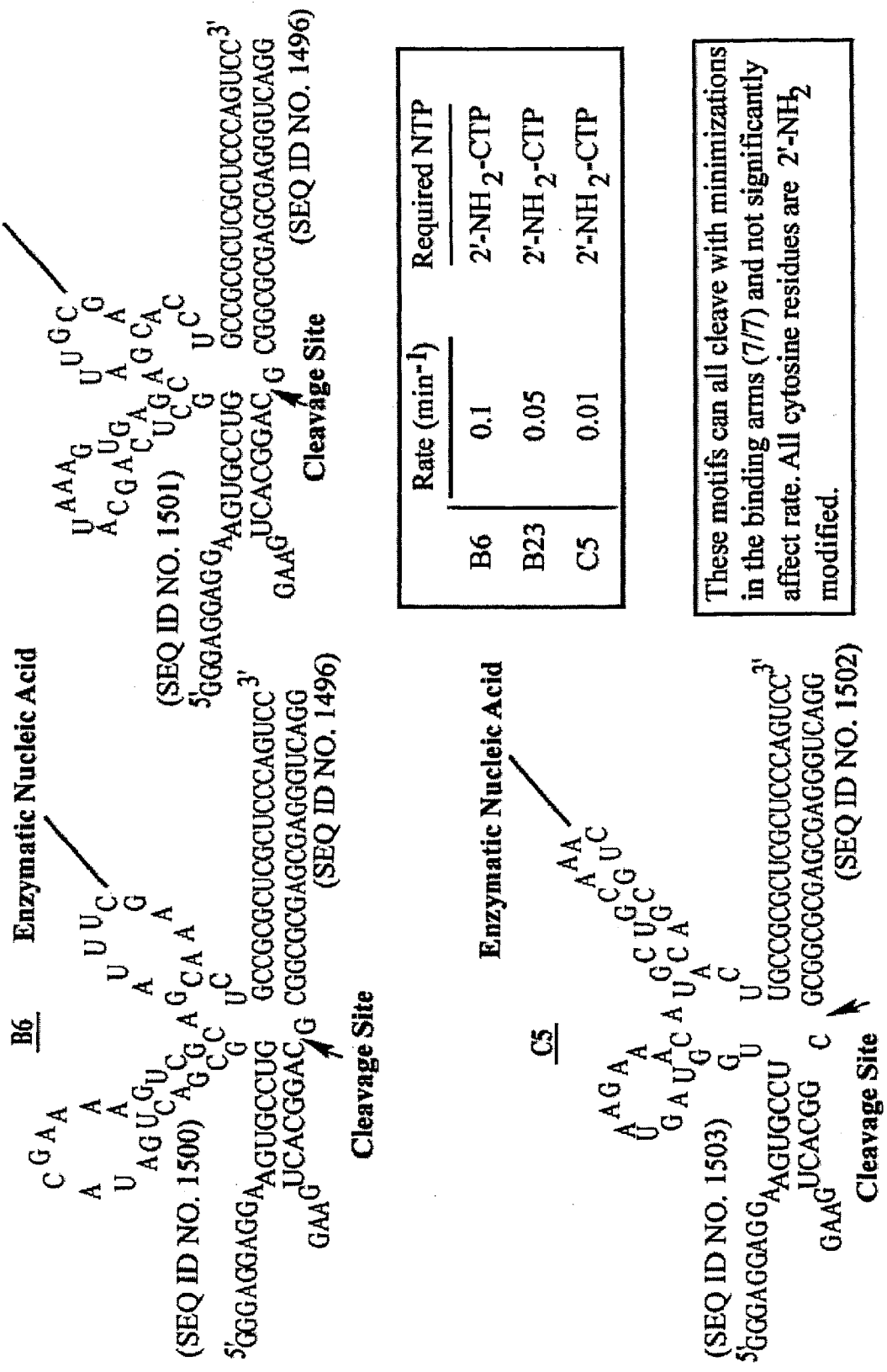
Figure 8b: *Class II Enzymatic Nucleic Acid Motifs*

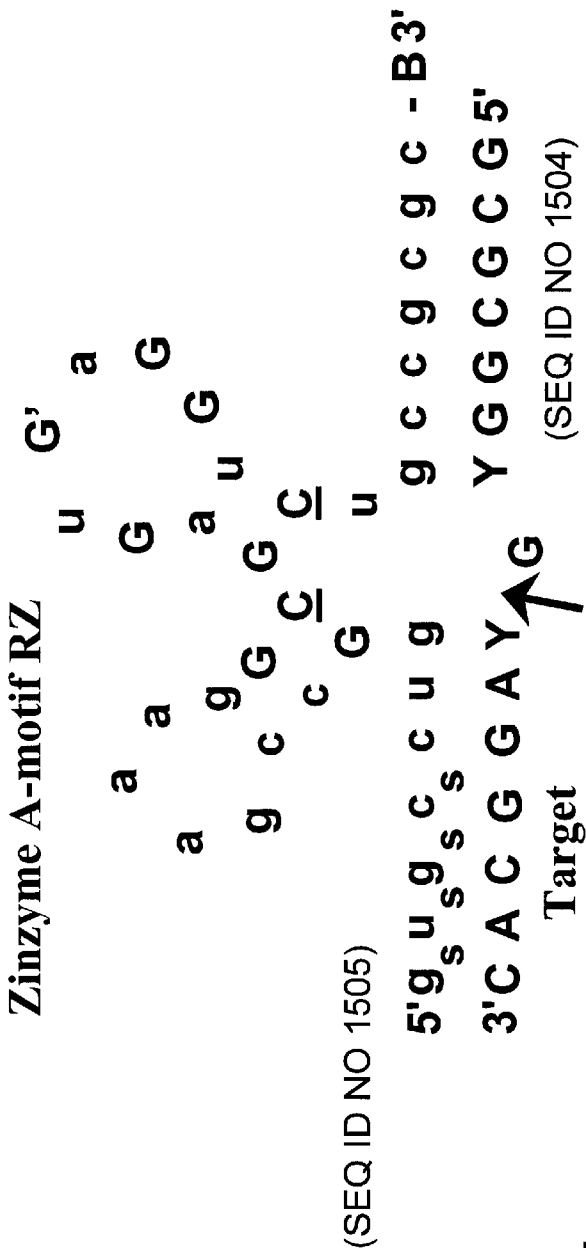
*Figure 9: Chemically Stabilized Class II Motif*

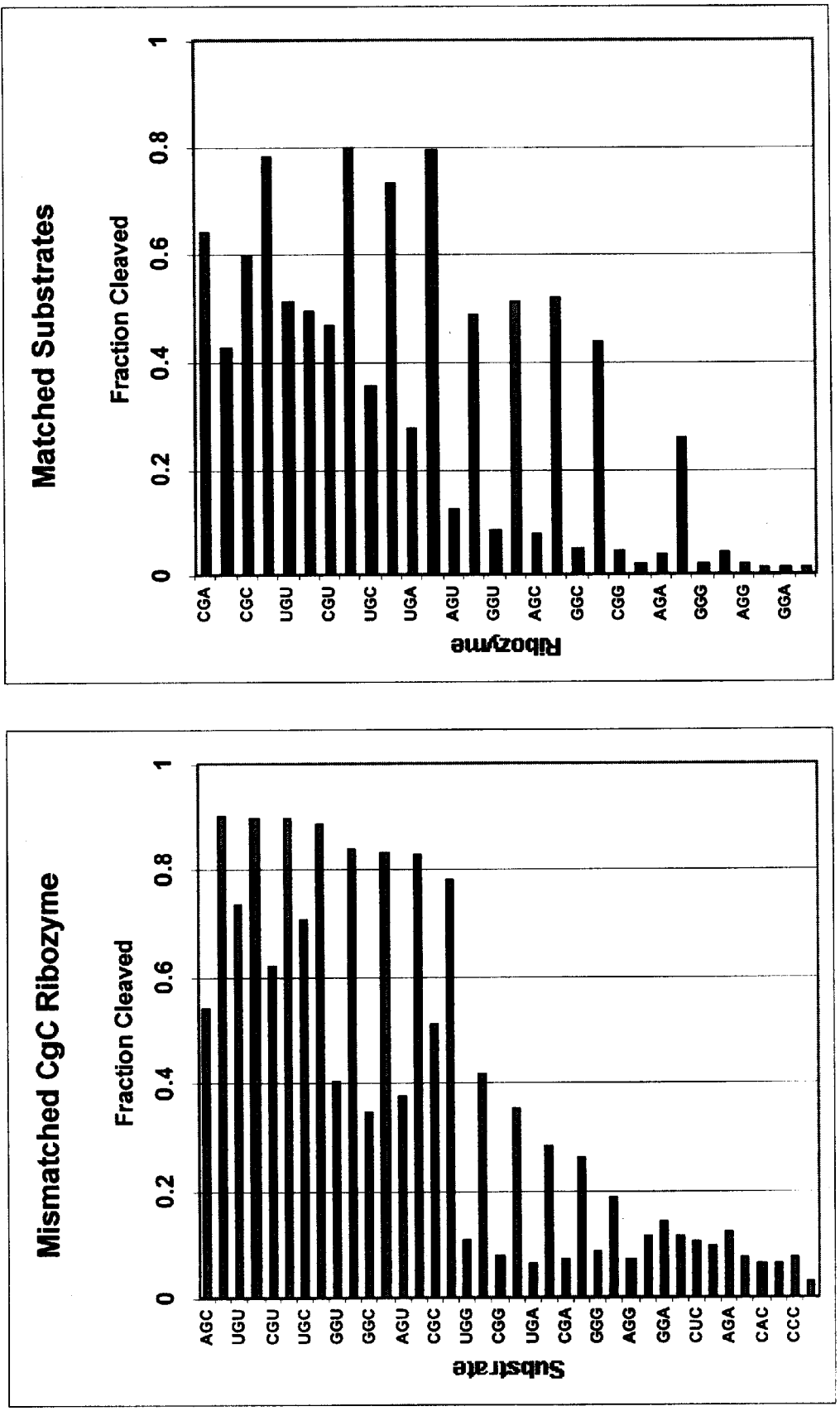
Figure 10: Substrate specificities of Class II (zinzyme) ribozymes

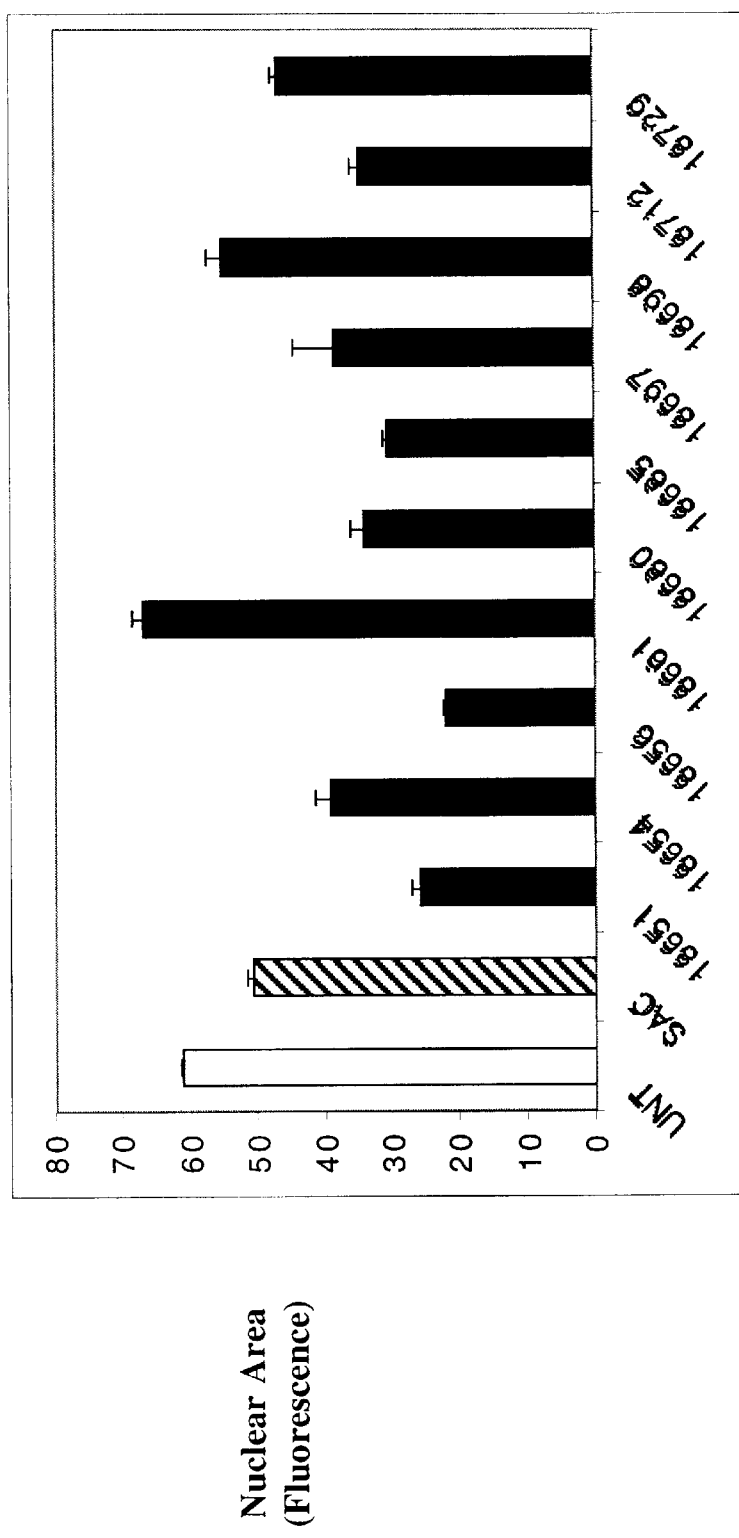
Figure 11: Representative data of HER2 cell proliferation primary screen of Class II (zinzyme) Ribozymes
SKBR3 breast carcinoma cells
2 μg/mL RPI.9649 (lipid)
200 nM ribozymes
120 hour timepoint
UNT = untreated
SAC = scrambled attenuated control

Figure 12: Synthesis of 5-[3-aminopropynyl(propyl)]uridine 5'-triphosphates and 4-imidazoleacetic acid conjugates

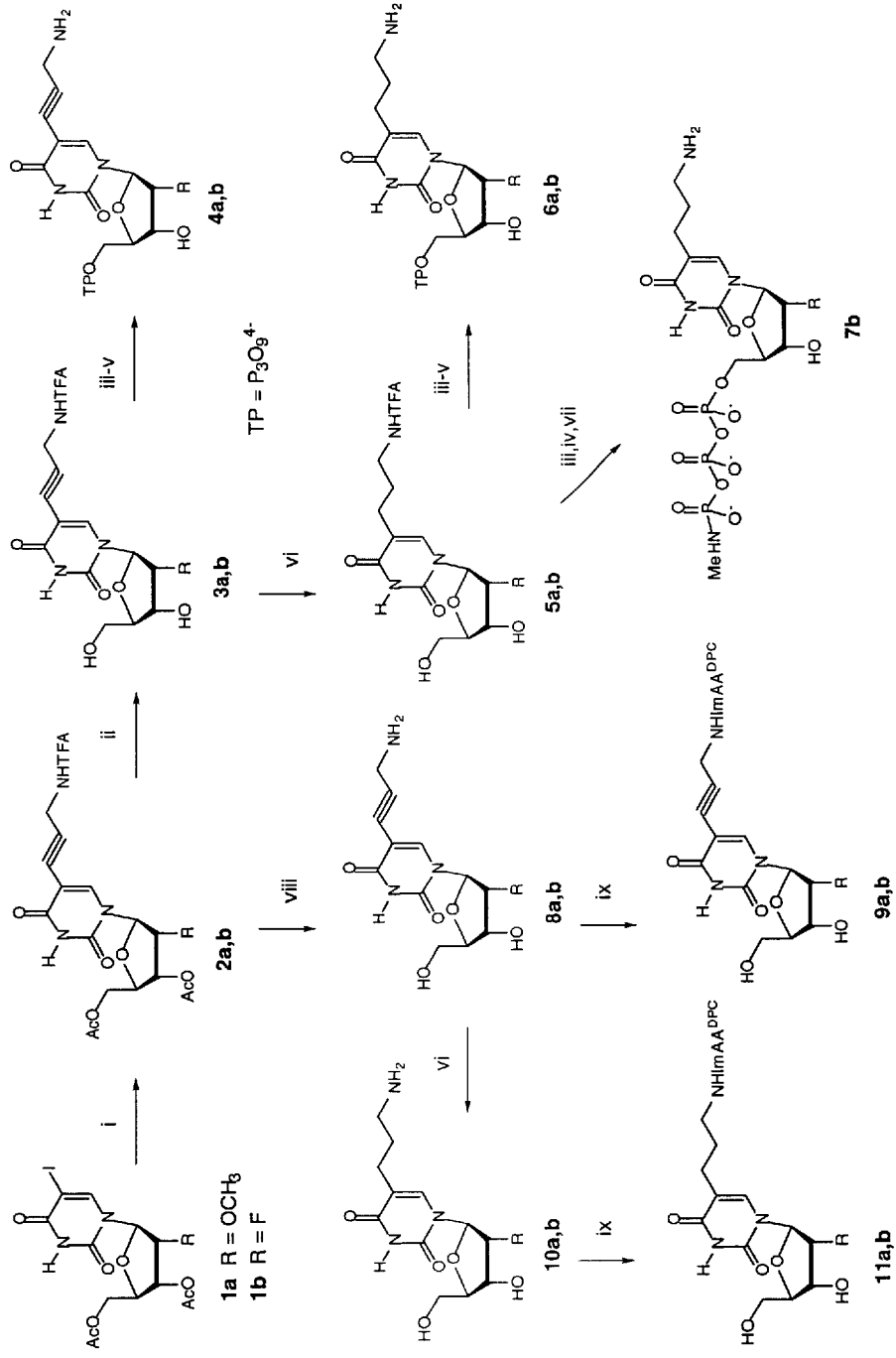

Reagents and Conditions: (I) *N*-TFA propargylamine, CuI, tetrakis(Ph$_3$P)Pd(0), Et$_3$N, DMF, 16 h, (ii) aq NaOH, pyr, MeOH, 0 °C, 1 h, (iii) POCl$_3$, Proton-Sponge, (EtO)$_3$PO, 2 h, (iv) *n*-Bu$_3$N PPi, MeCN, 15 min., (v) 1M Et$_3$NH$^+$HCO$_3^-$, then NH$_4$OH, 16 h, (vi) H$_2$, 5% Pd-C, 24 h, 40 psi, (vii) 40% MeNH$_2$, 3 h, (viii) NH$_4$OH, 4 °C, 16 h, (ix) ImAA$^{DPC}$, EDCHCl, DMF, 16 h.

Figure 13: Synthesis of 5-[3-(N-4-imidazoleacetyl0aminopropynyl(propyl)]uridine 5'-triphosphates
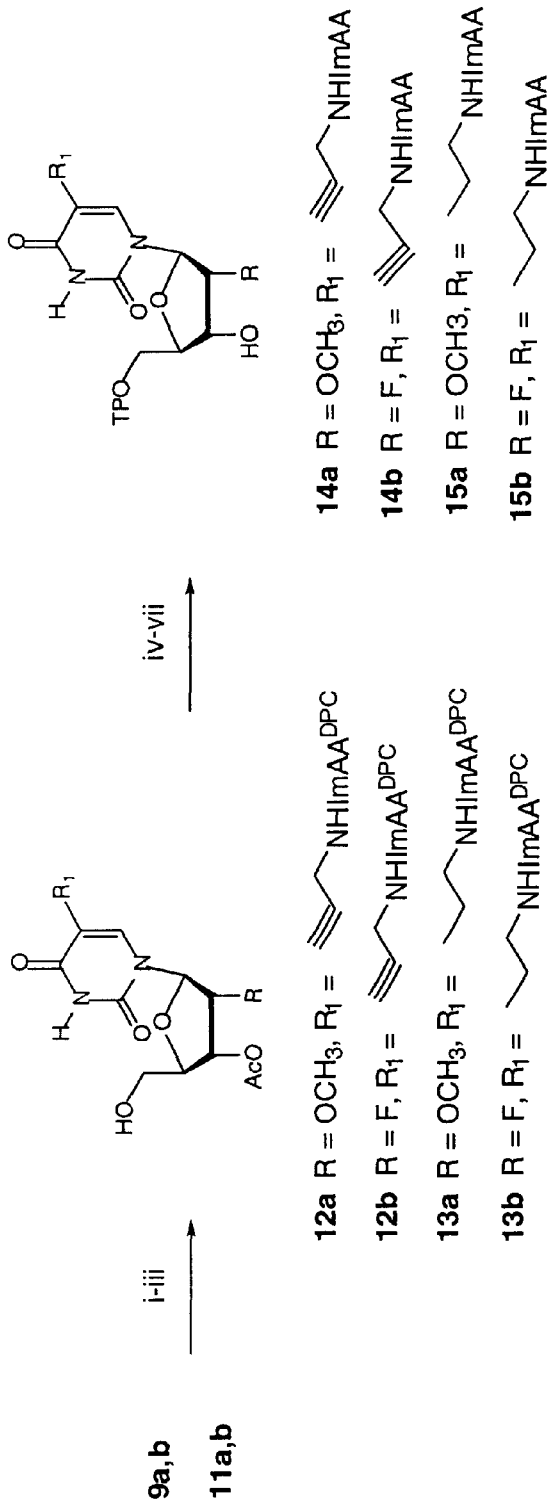
Reagents and Conditions: (I) DMT-Cl, pyr, 16 h, (ii) Ac$_2$O, pyr, 2 h, (iii) 3%TCA, CH$_2$Cl$_2$, 2 h, (iv) 2-Cl-4H-1,3,2-benzo-dioxaphosphorin-4-one, pyr, dioxane, 30 min., (v) n-Bu$_3$N PPi, DMF, 30 min., (vi) I$_2$, pyr-H$_2$O, 20 min., (vii) NH$_4$OH, 2 h.

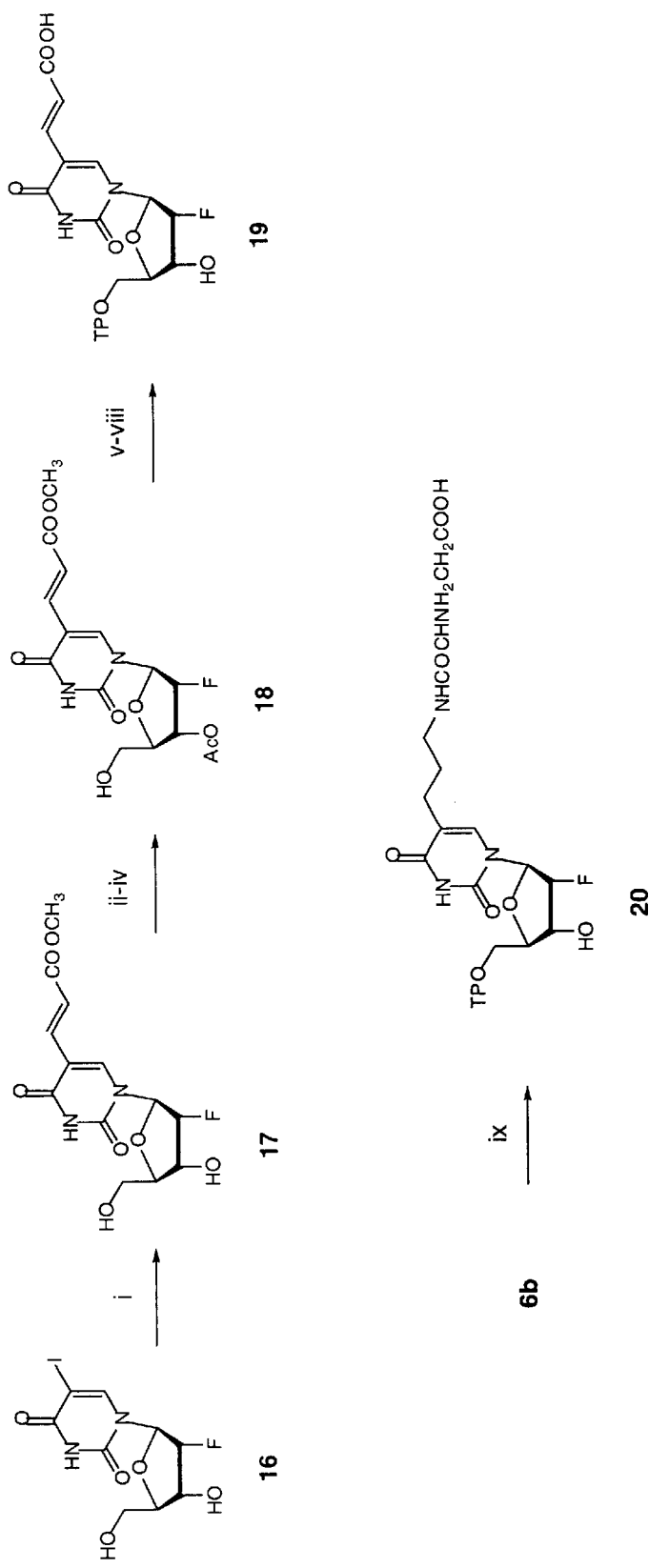
Figure 14: Synthesis of Carboxylate tethered uridine 5'-triphoates
Reagents and Conditions: (1) methyl acrylate, Ph₃P, Pd(II)acetate, Et₃N, dioxane, 30 min., reflux, (ii) DMT-Cl, pyr, 16 h. (iii) Ac₂O, pyr, 3 h. (iv) 3% TCA, CH₂Cl₂, 1 h, (v) 2-Cl-4H-1,3,2-benzodioxaphosphorin-4-one, pyr, dioxane, 30 min., (vi) n-Bu₃N PPi, DMF, 30 min., (vii) I₂, pyr-H₂O, 20 min., (viii) 1N NaOH, 5 h,
(ix) Fmoc-Asp-OFm NHS-ester, DMF-0.1M Na₂B₄O₇, 16 h, then Et₂NH, 3 h.

Figure 15: Synthesis of 5-(3-aminoalkyl) and 5-[3(N-succinyl)aminopropyl] functionalized cytidines

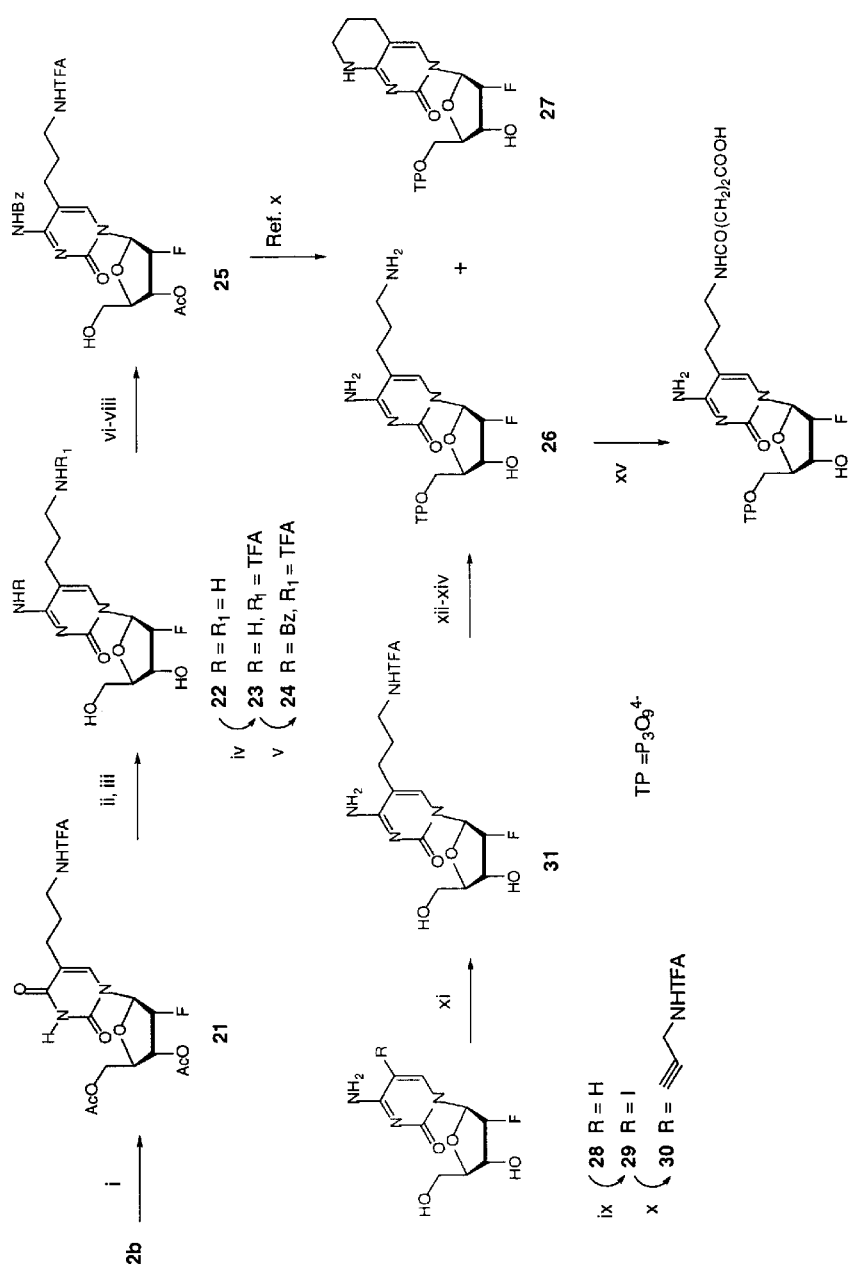

Reagents and Conditions: (i) $H_2$, 5% Pd-C, 24 h, 40 psi, (ii) $POCl_3$, 1,2,4-triazole, $Et_3N$, MeCN, 16 h, (iii), $NH_4OH$, dioxane, 16 h, (iv) $CF_3COOEt$, $Et_3N$, MeOH, reflux, 3 h, (v) $Bz_2O$, EtOH, reflux, 5 h, (vi) DMT-Cl, pyr, 16 h, (vii) $Ac_2O$, pyr, 3 h, (viii) 3% TCA, $CH_2Cl_2$, 3 h, (ix) $HIO_3$, $I_2$, AcOH, $CCl_4$, $H_2O$, 45 °C, 4 h, (x) N-TFA propargylamine, CuI, tetrakis($Ph_3P$)Pd(0), $Et_3N$, DMF, 16 h, (xi) $H_2$, 5% Pd-C, MeOH, 72 h, 40 psi, (xii) $POCl_3$, Proton-Sponge, $(MeO)_3PO$, 2 h, (xiii) $n$-$Bu_3N$ PPi, MeCN, 15 min., (xiv) $NH_4OH$, 4 °C, 16 h, (xv) succinic anhydride, DMF-0.1M $Na_2B_4O_7$ 1:1, 16 h.

Figure 16: *Class I ribozyme stem truncation/loop replacement*
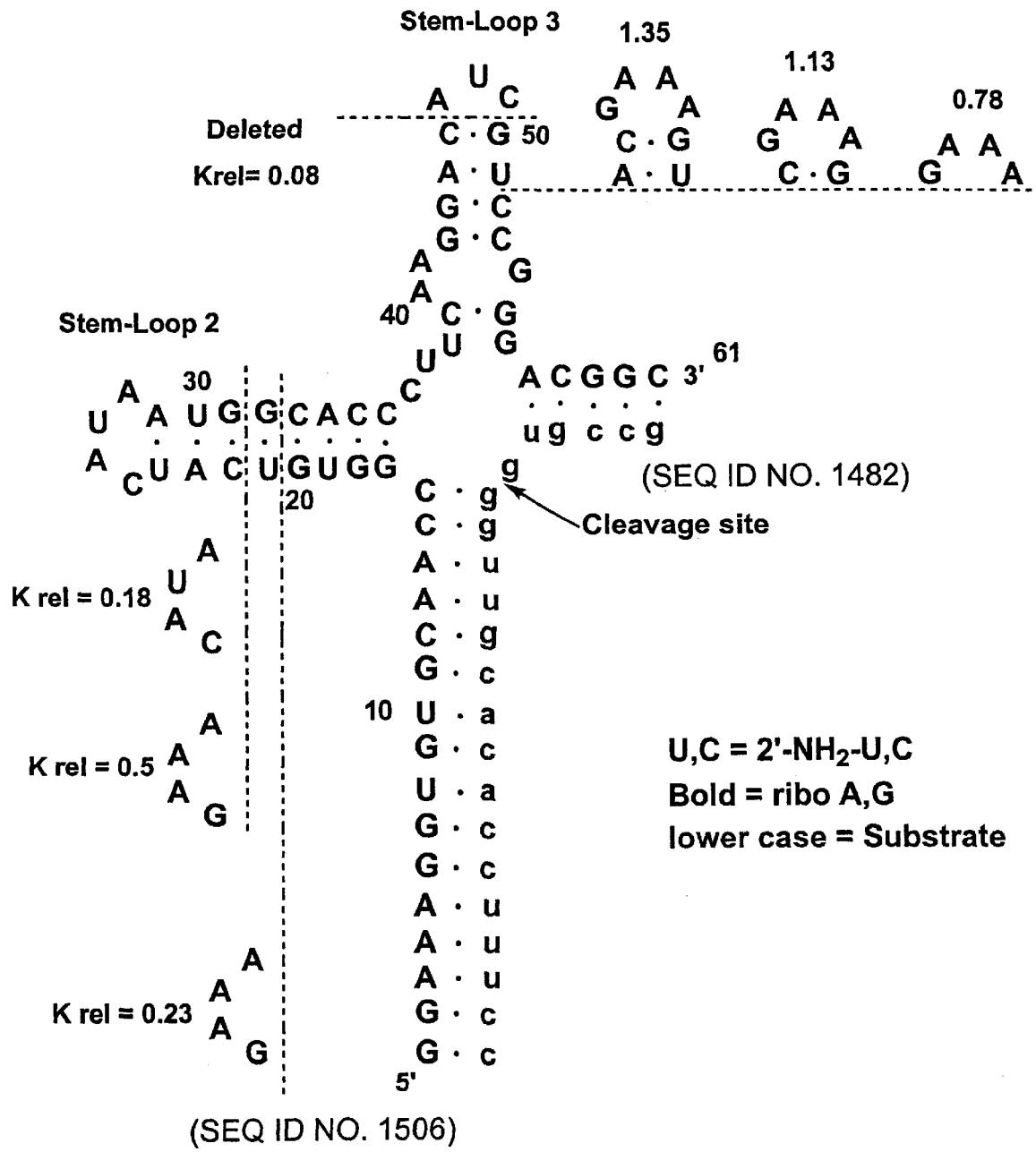

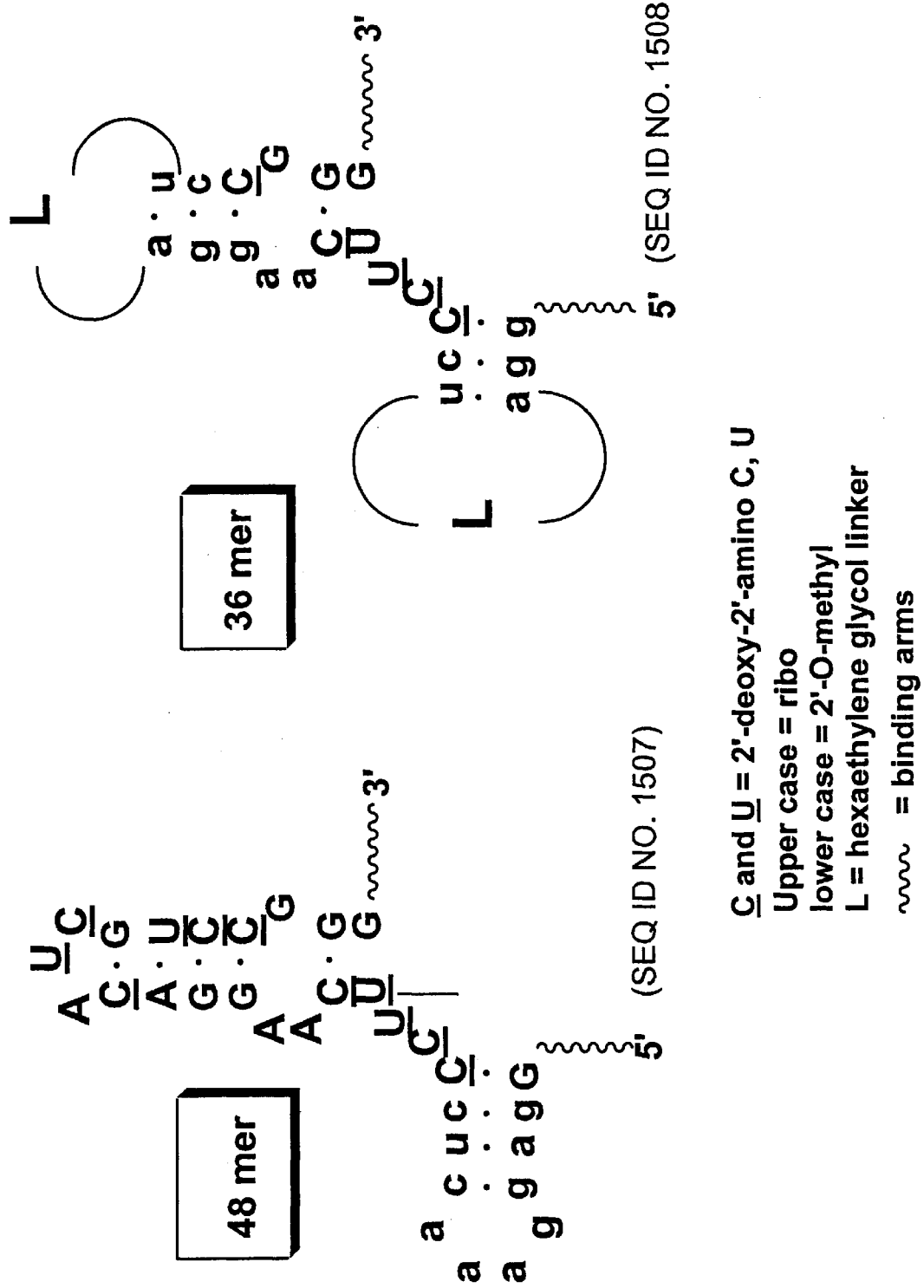
Figure 17: Class I ribozyme Stem truncation and Loop replacement

Figure 18: *Non ribo Class II (zinzyme) motifs*

Figure 19a

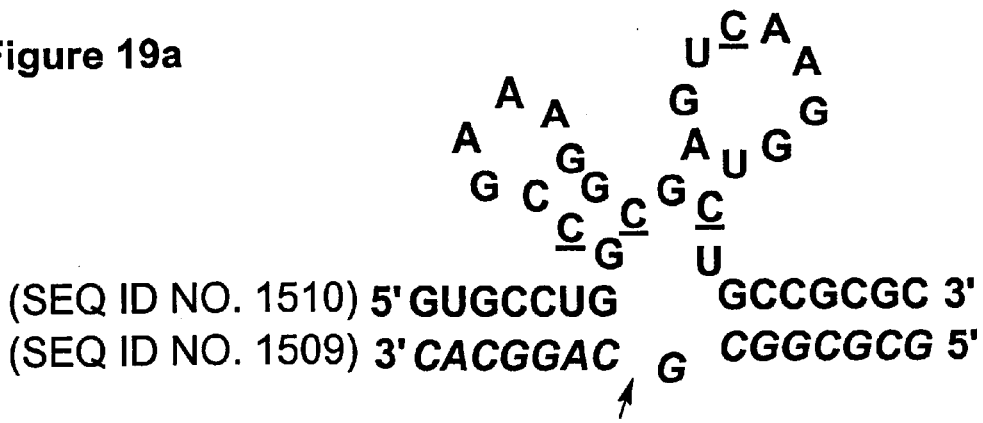

(SEQ ID NO. 1510) 5' GUGCCUG　　　GCCGCGC 3'
(SEQ ID NO. 1509) 3' *CACGGAC*　G　*CGGCGCG* 5'

Substrate is the Kras site 521

Figure 19b

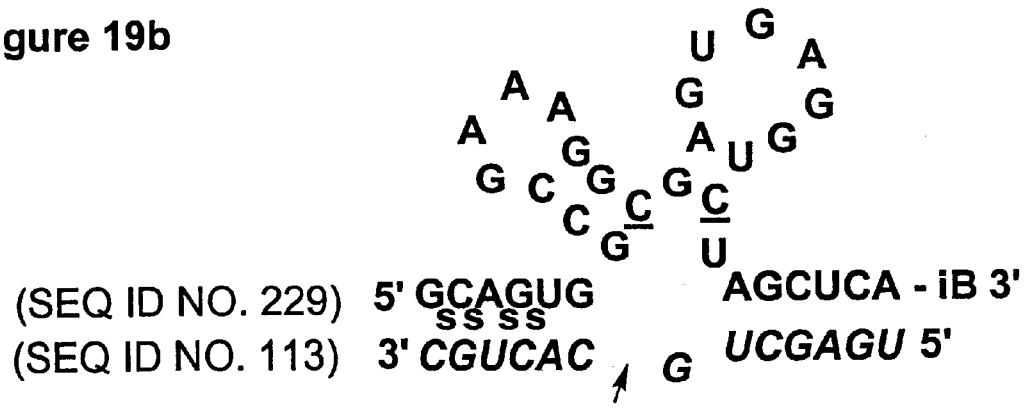

(SEQ ID NO. 229) 5' GCAGUG　　　AGCUCA - iB 3'
　　　　　　　　　　　ₛ ₛ ₛ ₛ
(SEQ ID NO. 113) 3' *CGUCAC*　G　*UCGAGU* 5'

Substrate is the HER2 site 972

Legend
*Italic* indicates natural ribo residues
C̲ indicates 2' - NH$_2$-C
A G C U indicates 2'-OMe residues
Subscript ₛ indicates phosphothioate linkage
iB indicates inverted deoxy abasic residue

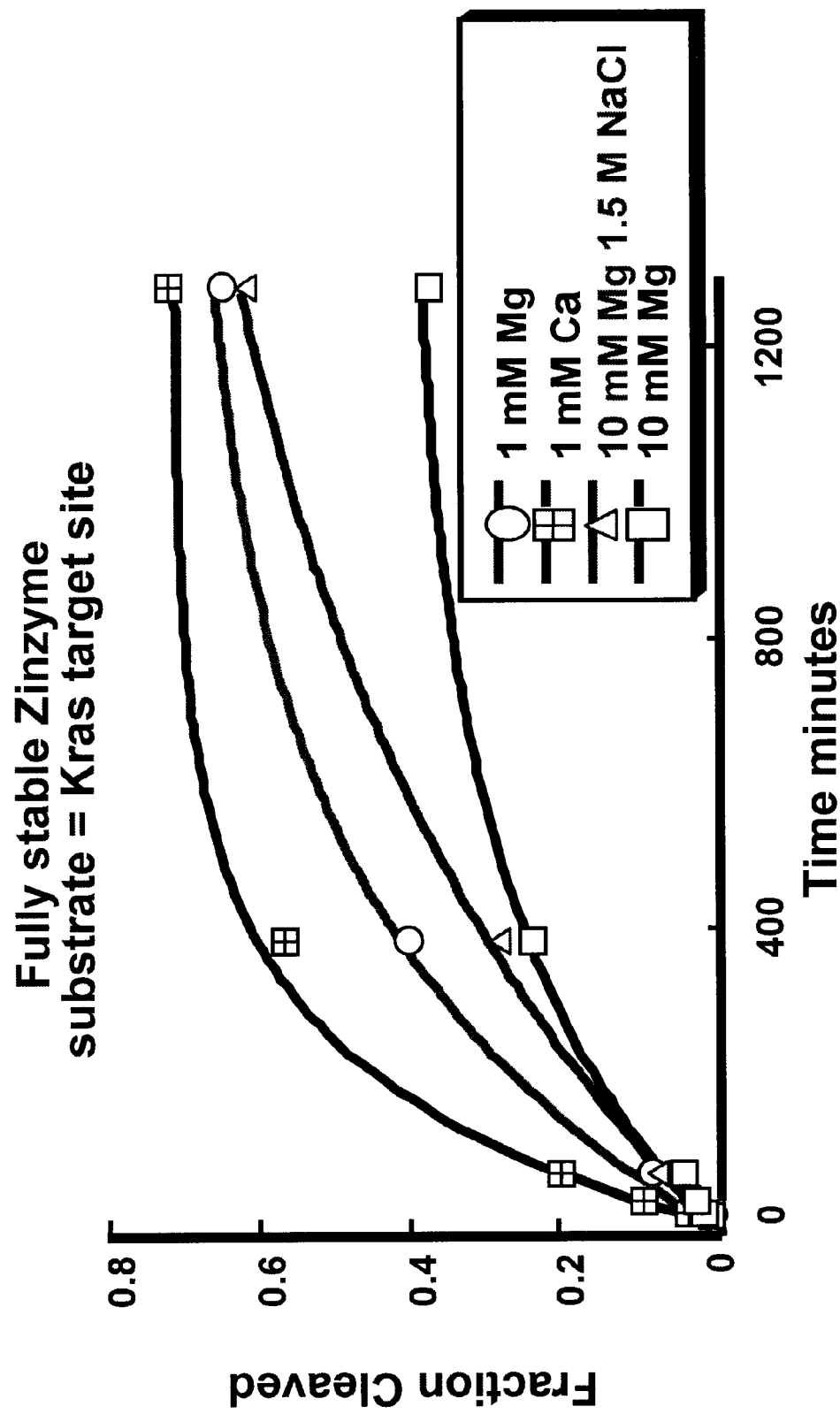
Figure 19: Non ribo Class II (zinzyme) cleavage reactions

Figure 20: *Positional testing of ribose positions in Class II (zinzyme) nucleic acid catalysts targeting HER2 site 972*
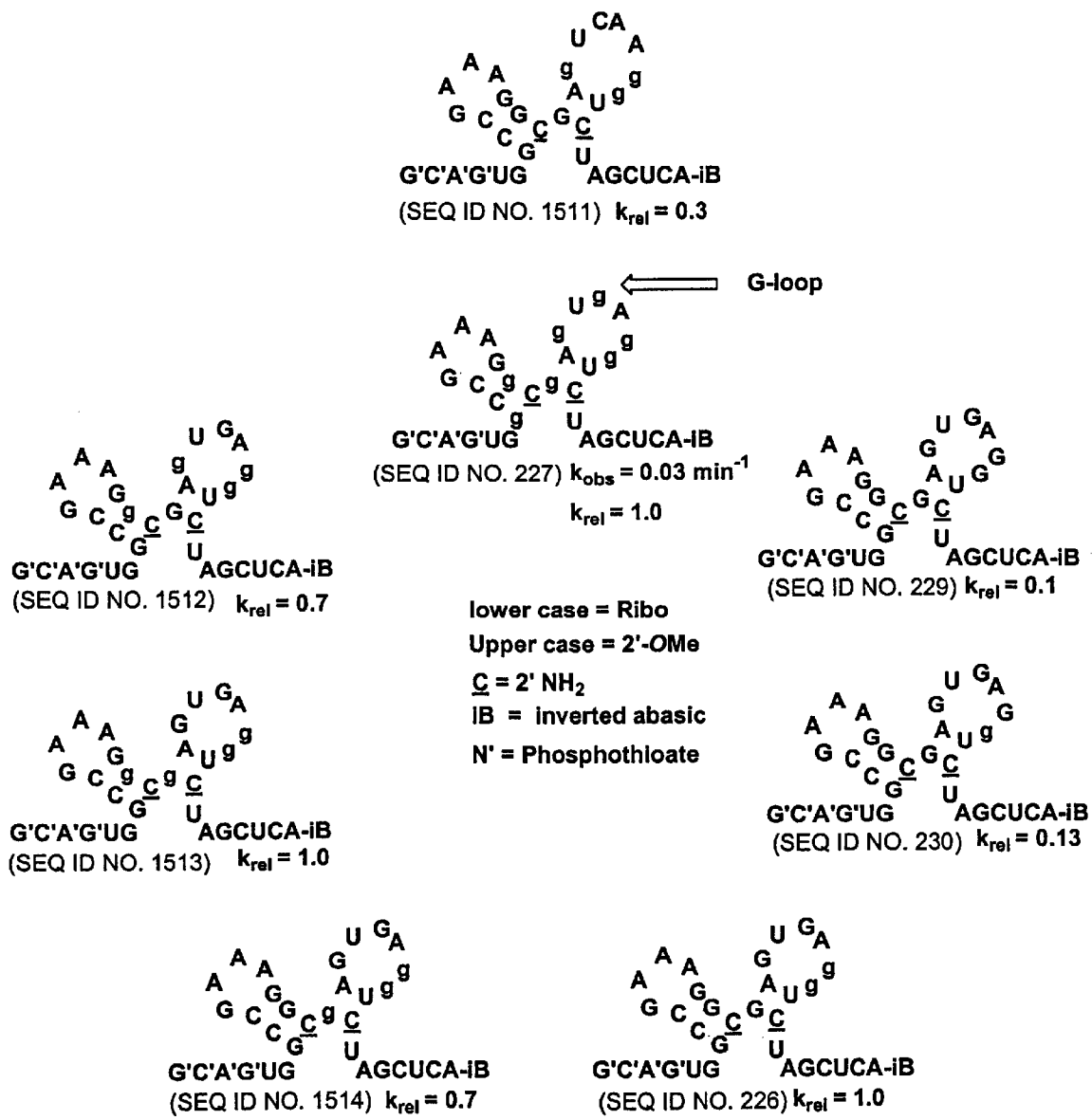
All assays done under selection conditions - physiological buffer
1 mM Mg, 1 mM Ca  37⁰ C
Susbstrate 15-mer HER2 site 972

SYNTHETIC RIBONUCLEIC ACIDS WITH RNASE ACTIVITY

RELATED APPLICATIONS

This patent application is a continuation-in-part of Beigelman et al., U.S. Ser. No. 09/301,511 filed Apr. 28, 1999, which is a continuation-in-part of Beigelman et al., U.S. Ser. No. 09/186,675 filed Nov. 4, 1998, now U.S. Pat. No. 6,127,535 and claims the benefit of Beigelman et al., U.S. S. No. 60/083,727, filed Apr. 29, 1998, and Beigelman et al., U.S. S. No. 60/064,866 filed Nov. 5, 1997, all of these earlier applications are entitled "NUCLEOTIDE TRIPHOSPHATES AND THEIR INCORPORATION INTO OLIGONUCLEOTIDES". Each patent is hereby incorporated by reference herein in its entirety, including the drawings.

The sequence Listing file named "MBHB00,831-B SequenceListing.txt" (438,990 bytes in size) submitted on Compact Disc-Recordable (CD-R) medium ("020206_1104") in compliance with 37 C.F.R. §1.52(e) is incorporated herein by reference.

BACKGROUND OF THE INVENTION

This invention relates to novel nucleotide triphosphates (NTPs); methods for synthesizing nucleotide triphosphates; and methods for incorporation of novel nucleotide triphosphates into oligonucleotides. The invention further relates to incorporation of these nucleotide triphosphates into nucleic acid molecules using polymerases under several novel reaction conditions.

The following is a brief description of nucleotide triphosphates. This summary is not meant to be complete, but is provided only to assist understanding of the invention that follows. This summary is not an admission that all of the work described below is prior art to the claimed invention.

The synthesis of nucleotide triphosphates and their incorporation into nucleic acids using polymerase enzymes has greatly assisted in the advancement of nucleic acid research. The polymerase enzyme utilizes nucleotide triphosphates as precursor molecules to assemble oligonucleotides. Each nucleotide is attached by a phosphodiester bond formed through nucleophilic attack by the 3' hydroxyl group of the oligonucleotide's last nucleotide onto the 5' triphosphate of the next nucleotide. Nucleotides are incorporated one at a time into the oligonucleotide in a 5' to 3' direction. This process allows RNA to be produced and amplified from virtually any DNA or RNA templates.

Most natural polymerase enzymes incorporate standard nucleotide triphosphates into nucleic acid. For example, a DNA polymerase incorporates dATP, dTTP, dCTP, and dGTP into DNA and an RNA polymerase generally incorporates ATP, CTP, UTP, and GTP into RNA. There are however, certain polymerases that are capable of incorporating non-standard nucleotide triphosphates into nucleic acids (Joyce, 1997, *PNAS* 94, 1619–1622, Huang et al., *Biochemistry* 36, 8231–8242).

Before nucleosides can be incorporated into RNA transcripts using polymerase enzymes they must first be converted into nucleotide triphosphates which can be recognized by these enzymes. Phosphorylation of unblocked nucleosides by treatment with POCl₃ and trialkyl phosphates was shown to yield nucleoside 5'-phosphorodichloridates (Yoshikawa et al., 1969, *Bull. Chem. Soc.(Japan)* 42, 3505). Adenosine or 2'-deoxyadenosine 5'-triphosphate was synthesized by adding an additional step consisting of treatment with excess tri-n-butylammonium pyrophosphate in DMF followed by hydrolysis (Ludwig, 1981, *Acta Biochim. et Biophys. Acad. Sci. Hung.* 16, 131–133).

Non-standard nucleotide triphosphates are not readily incorporated into RNA transcripts by traditional RNA polymerases. Mutations have been introduced into RNA polymerase to facilitate incorporation of deoxyribonucleotides into RNA (Sousa & Padilla, 1995, *EMBO J.* 14,4609–4621, Bonner et al., 1992, *EMBO J.* 11, 3767–3775, Bonner et al., 1994, *J Biol. Chem.* 42, 25120–25128, Aurup et al., 1992, *Biochemistry* 31, 9636–9641).

McGee et al., International PCT Publication No. WO 95/35102, describes the incorporation of 2'-NH₂-NTP's, 2'-F-NTP's, and 2'-deoxy-2'-benzyloxyamino UTP into RNA using bacteriophage T7 polymerase.

Wieczorek et al., 1994, *Bioorganic & Medicinal Chemistry Letters* 4, 987–994, describes the incorporation of 7-deaza-adenosine triphosphate into an RNA transcript using bacteriophage T7 RNA polymerase.

Lin et al., 1994, *Nucleic Acids Research* 22, 5229–5234, reports the incorporation of 2'-NH₂-CTP and 2'-NH₂-UTP into RNA using bacteriophage T7 RNA polymerase and polyethylene glycol containing buffer. The article describes the use of the polymerase synthesized RNA for in vitro selection of aptamers to human neutrophil elastase (HNE).

SUMMARY OF THE INVENTION

This invention relates to novel nucleotide triphosphate (NTP) molecules, and their incorporation into nucleic acid molecules, including nucleic acid catalysts. The NTPs of the instant invention are distinct from other NTPs known in the art. The invention further relates to incorporation of these nucleotide triphosphates into oligonucleotides using an RNA polymerase; the invention further relates to novel transcription conditions for the incorporation of modified (non-standard) and unmodified NTP's into nucleic acid molecules. Further, the invention relates to methods for synthesis of novel NTP's In a first aspect, the invention features NTP's having the formula triphosphate-OR, for example the following formula I:

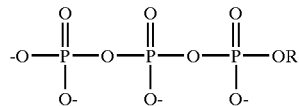

where R is any nucleoside; specifically the nucleosides 2'-O-methyl-2,6-diaminopurine riboside; 2'-deoxy-2'-amino-2,6-diaminopurine riboside; 2'-(N-alanyl)amino-2'-deoxy-uridine; 2'-(N-phenylalanyl)amino-2'-deoxy-uridine; 2'-deoxy-2'-(N-β-alanyl)amino; 2'-deoxy-2'-(lysiyl)amino uridine; 2'-C-allyl uridine; 2'-O-amino-uridine; 2'-O-methylthiomethyl adenosine; 2'-O-methylthiomethyl cytidine; 2'-O-methylthiomethyl guanosine; 2'-O-methylthiomethyl-uridine; 2'-deoxy-2'-(N-histidyl)amino uridine; 2'-deoxy-2'-amino-5-methyl cytidine; 2'-(N-β-carboxamidine-β-alanyl)amino-2'-deoxy-uridine; 2'-deoxy-2'-(N-β-alanyl)-guanosine; 2'-O-amino-adenosine; 2'-(N-lysyl)amino-2'-deoxy-cytidine; 2'-Deoxy-2'-(L-histidine) amino Cytidine; 5-Imidazoleacetic acid 2'-deoxy uridine, 5-[3-(N-4-imidazoleacetyl)aminopropynyl]-2'-O-methyl uridine, 5-(3-aminopropynyl)-2'-O-methyl uridine, 5-(3-aminopropyl)-2'-O-methyl uridine, 5-[3-(N-4-imidazoleacetyl)aminopropyl]-2'-O-methyl uridine, 5-(3-aminopropyl)-2'-deoxy-2-fluoro uridine, 2'-Deoxy-2'-(β- alanyl-L-histidyl)amino uridine, 2'-deoxy-2'-β-alaninamido-
uridine, 3-(2'-deoxy-2'-fluoro-β-D-ribofuranosyl)piperazino
[2,3-D]pyrimidine-2-one, 5-[3-(N-4-imidazoleacetyl)
aminopropyl]-2'-deoxy-2'-fluoro uridine, 5-[3-(N-4-
imidazoleacetyl)aminopropynyl]-2'-deoxy-2'-fluoro uridine,
5-E-(2-carboxyvinyl-2'-deoxy-2'-fluoro uridine, 5-[3-(N-4-
aspartyl)aminopropynyl-2'-fluoro uridine, 5-(3-
aminopropyl)-2'-deoxy-2-fluoro cytidine, and 5-[3-(N-4-
succynyl)aminopropyl-2'-deoxy-2-fluoro cytidine.

In a second aspect, the invention features inorganic and
organic salts of the nucleoside triphosphates of the instant
invention.

In a third aspect, the invention features a process for the
synthesis of pyrimidine nucleotide triphosphate (such as
UTP, 2'-O-MTM-UTP, dUTP and the like) including the
steps of monophosphorylation where the pyrimidine nucleo-
side is contacted with a mixture having a phosphorylating
agent (such as phosphorus oxychloride, phospho-tris-
trizolides, phospho-tris-triimidazolides and the like), trialkyl
phosphate (such as triethylphosphate or trimethylphosphate
or the like) and a hindered base (such as
dimethylaminopyridine, DMAP and the like) under condi-
tions suitable for the formation of pyrimidine monophos-
phate; and pyrophosphorylation where the pyrimidine
monophosphate is contacted with a pyrophosphorylating
reagent (such as tributylammonium pyrophosphate) under
conditions suitable for the formation of pyrimidine triphos-
phates.

The term "nucleotide" as used herein is as recognized in
the art to include natural bases (standard), and modified
bases well known in the art. Such bases are generally located
at the 1' position of a sugar moiety. Nucleotides generally
include a base, a sugar and a phosphate group. The nucle-
otides can be unmodified or modified at the sugar, phosphate
and/or base moiety, (also referred to interchangeably as
nucleotide analogs, modified nucleotides, non-natural
nucleotides, non-standard nucleotides and other; see for
example, Usman and McSwiggen, supra; Eckstein et al.,
International PCT Publication No. WO 92/07065; Usman et
al., International PCT Publication No. WO 93/15187; all
hereby incorporated by reference herein). There are several
examples of modified nucleic acid bases known in the art,
e.g., as recently summarized by Limbach et al., 1994,
*Nucleic Acids Res.* 22, 2183. Some of the non-limiting
examples of base modifications that can be introduced into
nucleic acids without significantly effecting their catalytic
activity include, inosine, purine, pyridin-4-one, pyridin-2-
one, phenyl, pseudouracil, 2, 4, 6-trimethoxy benzene,
3-methyl uracil, dihydrouridine, naphthyl, aminophenyl,
5-alkylcytidines (e.g., 5-methylcytidine), 5-alkyluridines
(e.g., ribothymidine), 5-halouridine (e.g., 5-bromouridine)
or 6-azapyrimidines or 6-alkylpyrimidines (e.g.
6-methyluridine) and others (Burgin et al., 1996,
*Biochemistry,* 35, 14090). By "modified bases" in this aspect
is meant nucleotide bases other than adenine, guanine,
cytosine thymine and uracil at 1' position or their equiva-
lents; such bases may be used within the catalytic core of an
enzymatic nucleic acid molecule and/or in the substrate-
binding regions of such a molecule. Such modified nucle-
otides include dideoxynucleotides which have pharmaceu-
tical utility well known in the art, as well as utility in basic
molecular biology methods such as sequencing.

By "ribonucleotide" is meant a nucleotide with a hydroxyl
group at the 2' position of a β-D-ribo-furanose moiety.

By "unmodified nucleoside" or "unmodified nucleotide"
is meant one of the bases adenine, cytosine, guanine, uracil
joined to the 1' carbon of β-D-ribo-furanose with substitu-
tions on either moiety.

By "modified nucleoside" or "modified nucleotide" is
meant any nucleotide base which contains a modification in
the chemical structure of an unmodified nucleotide base,
sugar and/or phosphate.

By "pyrimidines" is meant nucleotides comprising modi-
fied or unmodified derivatives of a six membered pyrimidine
ring. An example of a pyrimidine is modified or unmodified
uridine.

By "nucleotide triphosphate" or "NTP" is meant a nucleo-
side bound to three inorganic phosphate groups at the 5'
hydroxyl group of the modified or unmodified ribose or
deoxyribose sugar where the 1' position of the sugar may
comprise a nucleic acid base or hydrogen. The triphosphate
portion may be modified to include chemical moieties which
do not destroy the functionality of the group (i.e., allow
incorporation into an RNA molecule).

In another preferred embodiment, nucleotide triphos-
phates (NTPs) of the instant invention are incorporated into
an oligonucleotide using an RNA polymerase enzyme. RNA
polymerases include but are not limited to mutated and wild
type versions of bacteriophage T7, SP6, or T3 RNA poly-
merases. Applicant has also found that the NTPs of the
present invention can be incorporated into oligonucleotides
using certain DNA polymerases, such as Taq polymerase.

In yet another preferred embodiment, the invention fea-
tures a process for incorporating modified NTP's into an
oligonucleotide including the step of incubating a mixture
having a DNA template, RNA polymerase, NTP, and an
enhancer of modified NTP incorporation under conditions
suitable for the incorporation of the modified NTP into the
oligonucleotide.

By "enhancer of modified NTP incorporation" is meant a
reagent which facilitates the incorporation of modified
nucleotides into a nucleic acid transcript by an RNA poly-
merase. Such reagents include but are not limited to metha-
nol; LiCl; polyethylene glycol (PEG); diethyl ether; pro-
panol; methyl amine; ethanol and the like.

In another preferred embodiment, the modified nucleotide
triphosphates can be incorporated by transcription into a
nucleic acid molecules including enzymatic nucleic acid,
antisense, 2-5A antisense chimera, oligonucleotides, triplex
forming oligonucleotide (TFO), aptamers and the like (Stull
et al., 1995 *Pharmaceutical Res.* 12, 465).

By "antisense" it is meant a non-enzymatic nucleic acid
molecule that binds to target RNA by means of RNA-RNA
or RNA-DNA or RNA-PNA (protein nucleic acid; Egholm
et al., 1993 *Nature* 365, 566) interactions and alters the
activity of the target RNA (for a review, see Stein and
Cheng, 1993 *Science* 261, 1004; Agrawal et al., U.S. Pat.
No. 5,591,721; Agrawal, U.S. Pat. No. 5,652,356).
Typically, antisense molecules will be complementary to a
target sequence along a single contiguous sequence of the
antisense molecule. However, in certain embodiments, an
antisense molecule may bind to substrate such that the
substrate molecule forms a loop, and/or an antisense mol-
ecule may bind such that the antisense molecule forms a
loop. Thus, the antisense molecule may be complementary
to two (or even more) non-contiguous substrate sequences or
two (or even more) non-contiguous sequence portions of an
antisense molecule may be complementary to a target
sequence or both.

By "2-5A antisense chimera" it is meant, an antisense
oligonucleotide containing a 5' phosphorylated 2'-5'-linked
adenylate residues. These chimeras bind to target RNA in a
sequence-specific manner and activate a cellular 2-5A-
dependent ribonuclease which, in turn, cleaves the target
RNA (Torrence et al., 1993 *Proc. Natl. Acad. Sci. USA* 90,
1300).

By "triplex forming oligonucleotides (TFO)" it is meant an oligonucleotide that can bind to a double-stranded DNA in a sequence-specific manner to form a triple-strand helix. Formation of such triple helix structure has been shown to inhibit transcription of the targeted gene (Duval-Valentin et al., 1992 *Proc. Natl. Acad. Sci. USA* 89, 504).

By "oligonucleotide" as used herein is meant a molecule having two or more nucleotides. The polynucleotide can be single, double or multiple stranded and may have modified or unmodified nucleotides or non-nucleotides or various mixtures and combinations thereof.

By "nucleic acid catalyst" is meant a nucleic acid molecule capable of catalyzing (altering the velocity and/or rate of) a variety of reactions including the ability to repeatedly cleave other separate nucleic acid molecules (endonuclease activity) in a nucleotide base sequence-specific manner. Such a molecule with endonuclease activity may have complementarity in a substrate binding region to a specified gene target, and also has an enzymatic activity that specifically cleaves RNA or DNA in that target. That is, the nucleic acid molecule with endonuclease activity is able to intramolecularly or intermolecularly cleave RNA or DNA and thereby inactivate a target RNA or DNA molecule. This complementarity functions to allow sufficient hybridization of the enzymatic RNA molecule to the target RNA or DNA to allow the cleavage to occur. 100% complementarity is preferred, but complementarity as low as 50–75% may also be useful in this invention. The nucleic acids may be modified at the base, sugar, and/or phosphate groups. The term enzymatic nucleic acid is used interchangeably with phrases such as ribozymes, catalytic RNA, enzymatic RNA, catalytic DNA, catalytic oligonucleotides, nucleozyme, DNAzyme, RNA enzyme, endoribonuclease, endonuclease, minizyme, leadzyme, oligozyme, finderon or DNA enzyme. All of these terminologies describe nucleic acid molecules with enzymatic activity. The specific enzymatic nucleic acid molecules described in the instant application are not limiting in the invention and those skilled in the art will recognize that all that is important in an enzymatic nucleic acid molecule of this invention is that it has a specific substrate binding site which is complementary to one or more of the target nucleic acid regions, and that it have nucleotide sequences within or surrounding that substrate binding site which impart a nucleic acid cleaving activity to the molecule (Cech et al., U.S. Pat. No. 4,987,071; Cech et al., 1988, 260 *JAMA* 3030).

By "enzymatic portion" or "catalytic domain" is meant that portion/region of the enzymatic nucleic acid molecule essential for cleavage of a nucleic acid substrate.

By "substrate binding arm" or "substrate binding domain" is meant that portion/region of an enzymatic nucleic acid molecule which is complementary to (i.e., able to base-pair with) a portion of its substrate. Generally, such complementarity is 100%, but can be less if desired. For example, as few as 10 bases out of 14 may be base-paired. That is, these arms contain sequences within a enzymatic nucleic acid molecule which are intended to bring enzymatic nucleic acid molecule and target together through complementary base-pairing interactions. The enzymatic nucleic acid molecule of the invention may have binding arms that are contiguous or non-contiguous and may be varying lengths. The length of the binding arm(s) are preferably greater than or equal to four nucleotides; specifically 12–100 nucleotides; more specifically 14–24 nucleotides long. If two binding arms are chosen, the design is such that the length of the binding arms are symmetrical (i.e., each of the binding arms is of the same length; e.g., five and five nucleotides, six and six nucleotides or seven and seven nucleotides long) or asymmetrical (i.e., the binding arms are of different length; e.g., six and three nucleotides; three and six nucleotides long; four and five nucleotides long; four and six nucleotides long; four and seven nucleotides long; and the like).

By "nucleic acid molecule" as used herein is meant a molecule having nucleotides. The nucleic acid can be single, double or multiple stranded and may comprise modified or unmodified nucleotides or non-nucleotides or various mixtures and combinations thereof. An example of a nucleic acid molecule according to the invention is a gene which encodes for a macromolecule such as a protein.

In preferred embodiments of the present invention, a nucleic acid molecule, e.g., an antisense molecule, a triplex DNA, or an enzymatic nucleic acid molecule, is 13 to 100 nucleotides in length, e.g., in specific embodiments 35, 36, 37, or 38 nucleotides in length (e.g., for particular ribozymes). In particular embodiments, the nucleic acid molecule is 15–100, 17–100, 20–100, 21–100, 23–100, 25–100, 27–100, 30–100, 32–100, 35–100, 40–100, 50–100, 60–100, 70–100, or 80–100 nucleotides in length. Instead of 100 nucleotides being the upper limit on the length ranges specified above, the upper limit of the length range can be, for example, 30, 40, 50, 60, 70, or 80 nucleotides. Thus, for any of the length ranges, the length range for particular embodiments has lower limit as specified, with an upper limit as specified which is greater than the lower limit. For example, in a particular embodiment, the length range can be 35–50 nucleotides in length. All such ranges are expressly included. Also in particular embodiments, a nucleic acid molecule can have a length which is any of the lengths specified above, for example, 21 nucleotides in length.

By "complementarity" is meant that a nucleic acid can form hydrogen bond(s) with another RNA sequence by either traditional Watson-Crick or other non-traditional types. In reference to the nucleic molecules of the present invention, the binding free energy for a nucleic acid molecule with its target or complementary sequence is sufficient to allow the relevant function of the nucleic acid to proceed, e.g., enzymatic nucleic acid cleavage, antisense or triple helix inhibition. Determination of binding free energies for nucleic acid molecules is well-known in the art (see, e.g., Turner et al., 1987, *CSH Symp. Quant. Biol. LII* pp.123–133; Frier et al., 1986, *Proc. Nat. Acad. Sci. USA* 83:9373–9377; Turner et al., 1987, *J. Am. Chem. Soc.* 109:3783–3785. A percent complementarity indicates the percentage of contiguous residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence.

In yet another preferred embodiment, the modified nucleotide triphosphates of the instant invention can be used for combinatorial chemistry or in vitro selection of nucleic acid molecules with novel function. Modified oligonucleotides can be enzymatically synthesized to generate libraries for screening.

In another preferred embodiment, the invention features nucleic acid based techniques (e.g., enzymatic nucleic acid molecules), antisense nucleic acids, 2-5A antisense chimeras, triplex DNA, antisense nucleic acids containing RNA cleaving chemical groups) isolated using the methods described in this invention and methods for their use to diagnose, down regulate or inhibit gene expression.

In yet another perferred embodiment, the invention features enzymatic nucleic acid molecules targeted against HER2 RNA, specifically including ribozymes in the class II (zinzyme) motif.

By "inhibit" it is meant that the activity of target genes or level of mRNAs or equivalent RNAs encoding target genes is reduced below that observed in the absence of the nucleic acid molecules of the instant invention (e.g., enzymatic nucleic acid molecules), antisense nucleic acids, 2-5A antisense chimeras, triplex DNA, antisense nucleic acids containing RNA cleaving chemical groups). In one embodiment, inhibition with enzymatic nucleic acid molecule preferably is below that level observed in the presence of an enzymatically attenuated nucleic acid molecule that is able to bind to the same site on the mRNA, but is unable to cleave that RNA. In another embodiment, inhibition with nucleic acid molecules, including enzymatic nucleic acid and antisense molecules, is preferably greater than that observed in the presence of for example, an oligonucleotide with scrambled sequence or with mismatches. In another embodiment, inhibition of target genes with the nucleic acid molecule of the instant invention is greater than in the presence of the nucleic acid molecule than in its absence.

In yet another preferred embodiment, the invention features a process for incorporating a plurality of compounds of formula I.

In yet another embodiment, the invention features a nucleic acid molecule with catalytic activity having formula II:

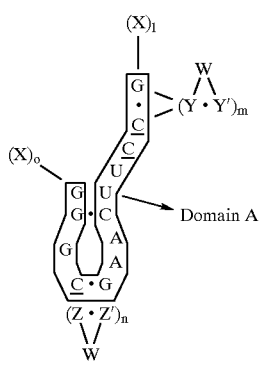

In the formula shown above X, Y, and Z represent independently a nucleotide or a non-nucleotide linker, which may be same or different; . indicates hydrogen bond formation between two adjacent nucleotides which may or may not be present; Y' is a nucleotide complementary to Y; Z' is a nucleotide complementary to Z; l is an integer greater than or equal to 3 and preferably less than 20, more specifically 4, 5, 6, 7, 8, 9, 10, 11, 12, or 15; m is an integer greater than 1 and preferably less than 10, more specifically 2, 3, 4, 5, 6, or 7; n is an integer greater than 1 and preferably less than 10, more specifically 3, 4, 5, 6, or 7; o is an integer greater than or equal to 3 and preferably less than 20, more specifically 3, 4, 5, 6, 7, 8, 9, 10, 11, 12, or 15; l and o may be the same length (l=o) or different lengths (l≠o); each X(l) and X(o) are oligonucleotides which are of sufficient length to stably interact independently with a target nucleic acid sequence (the target can be an RNA, DNA or RNA/DNA mixed polymers); W is a linker of ≧2 nucleotides in length or may be a non-nucleotide linker; A, U, C, and G represent the nucleotides; G is a nucleotide, preferably 2'-O-methyl or ribo; A is a nucleotide, preferably 2'-O-methyl or ribo; U is a nucleotide, preferably 2'-amino (e.g., 2'-NH$_2$ or 2'-O—NH$_2$), 2'-O-methyl or ribo; C represents a nucleotide, preferably 2'-amino (e.g., 2'-NH$_2$ or 2'-O—NH$_2$), and __ represents a chemical linkage (e.g. a phosphate ester linkage, amide linkage, phosphorothioate, phosphorodithioate or others known in the art).

In yet another embodiment, the invention features a nucleic acid molecule with catalytic activity having formula III (SEQ ID NO: 1519):

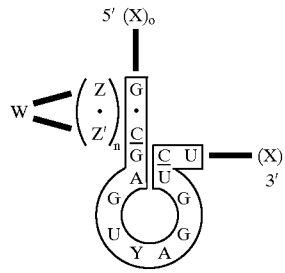

In the formula shown above X, Y, and Z represent independently a nucleotide or a non-nucleotide linker, which may be same or different; . indicates hydrogen bond formation between two adjacent nucleotides which may or may not be present; Z' is a nucleotide complementary to Z; l is an integer greater than or equal to 3 and preferably less than 20, more specifically 4, 5, 6, 7, 8, 9, 10, 11, 12, or 15; n is an integer greater than 1 and preferably less than 10, more specifically 3, 4, 5, 6, or 7; o is an integer greater than or equal to 3 and preferably less than 20, more specifically 3, 4, 5, 6, 7, 8, 9, 10, 11, 12, or 15; l and o may be the same length (l=o) or different lengths (l≠o); each X(l) and X(o) are oligonucleotides which are of sufficient length to stably interact independently with a target nucleic acid sequence (the target can be an RNA, DNA or RNA/DNA mixed polymers); X(o) preferably has a G at the 3'-end, X(l) preferably has a G at the 5'-end; W is a linker of ≧2 nucleotides in length or may be a non-nucleotide linker; Y is a linker of ≧1 nucleotides in length, preferably G, 5'-CA-3', or 5'-CAA-3', or may be a non-nucleotide linker; A, U, C, and G represent the nucleotides; G is a nucleotide, preferably 2'-O-methyl, 2'-deozy-2'-fluoro, or 2'-OH; A is a nucleotide, preferably 2'-O-methyl, 2'-deozy-2'-fluoro, or 2'-OH; U is a nucleotide, preferably 2'-O-methyl, 2'-deozy-2'-fluoro, or 2'-OH; C represents a nucleotide, preferably 2'-amino (e.g., 2'-NH$_2$ or 2'-O—NH$_2$, and __ represents a chemical linkage (e.g. a phosphate ester linkage, amide linkage, phosphorothioate, phosphorodithioate or others known in the art).

The enzymatic nucleic acid molecules of Formula II and Formula III may independently comprise a cap structure which may independently be present or absent.

By "sufficient length" is meant an oligonucleotide of greater than or equal to 3 nucleotides that is of a length great enough to provide the intended function under the expected condition. For example, for binding arms of enzymatic nucleic acid "sufficient length" means that the binding arm sequence is long enough to provide stable binding to a target site under the expected binding conditions. Preferably, the binding arms are not so long as to prevent useful turnover.

By "stably interact" is meant, interaction of the oligonucleotides with target nucleic acid (e.g., by forming hydrogen bonds with complementary nucleotides in the target under physiological conditions).

By "chimeric nucleic acid molecule" or "chimeric oligonucleotide" is meant that, the molecule may be comprised of both modified or unmodified DNA or RNA.

By "cap structure" is meant chemical modifications, which have been incorporated at a terminus of the oligonucleotide. These terminal modifications protect the nucleic acid molecule from exonuclease degradation, and may help in delivery and/or localization within a cell. The cap may be present at the 5'-terminus (5'-cap) or at the 3'-terminus (3'-cap) or may be present on both termini. In non-limiting examples the 5'-cap is selected from the group comprising inverted abasic residue (moiety), 4',5'-methylene nucleotide, 1-(beta-D-erythrofuranosyl)nucleotide, 4'-thio nucleotide, carbocyclic nucleotide; 1,5-anhydrohexitol nucleotide; L-nucleotides; alpha-nucleotides, modified base nucleotide, phosphorodithioate linkage, threo-pentofuranosyl nucleotide, acyclic 3',4'-seco nucleotide, acyclic 3,4-dihydroxybutyl nucleotide, acyclic 3,5-dihydroxypentyl nucleotide, 3'-3'-inverted nucleotide moiety, 3'-3'-inverted abasic moiety; 3'-2'-inverted nucleotide moiety; 3'-2'-inverted abasic moiety; 1,4-butanediol phosphate, 3'-phosphoramidate, hexylphosphate, aminohexyl phosphate; 3'-phosphate, 3'-phosphorothioate, phosphorodithioate, or bridging or non-bridging methylphosphonate moiety (for more details see Beigelman et al., International PCT publication No. WO 97/26270, incorporated by reference herein). In yet another preferred embodiment the 3'-cap is selected from a group comprising, 4',5'-methylene nucleotide, 1-(beta-D-erythrofuranosyl) nucleotide, 4'-thio nucleotide, carbocyclic nucleotide, 5'-amino-alkyl phosphate, 1,3-diamino-2-propyl phosphate, 3-aminopropyl phosphate, 6-aminohexyl phosphate, 1,2-aminododecyl phosphate, hydroxypropyl phosphate, 1,5-anhydrohexitol nucleotide, L-nucleotide, alpha-nucleotide, modified base nucleotide, phosphorodithioate, threo-pentofuranosyl nucleotide, acyclic 3',4'-seco nucleotide, 3,4-dihydroxybutyl nucleotide, 3,5-dihydroxypentyl nucleotide, 5'-5'-inverted nucleotide moiety, 5'-5'-inverted abasic moiety, 5'-phosphoramidate, 5'-phosphorothioate, 1,4-butanediol phosphate, 5'-amino; bridging and/or non-bridging 5'-phosphoramidate, phosphorothioate and/or phosphorodithioate, bridging or non bridging methylphosphonate and 5'-mercapto moieties (for more details see Beaucage and Iyer, 1993, *Tetrahedron* 49, 1925; incorporated by reference herein). By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine. The terms "abasic" or "abasic nucleotide" as used herein encompass sugar moieties lacking a base or having other chemical groups in place of base at the 1' position.

In connection with 2'-modified nucleotides as described for the present invention, by "amino" is meant 2'-$NH_2$ or 2'-O—$NH_2$, which may be modified or un-modified. Such modified groups are described, for example, in Eckstein et al.; U.S. Pat. No. 5,672,695 and Matulic-Adamic et al., WO 98/28317, respectively, wherein the U.S. Patent is incorporated by reference in its entirety.

DESCRIPTION OF THE PREFERRED EMBODIMENTS

The drawings will first briefly be described.

DRAWINGS

FIG. 1 displays a schematic representation of NTP synthesis using nucleoside substrates.

FIG. 2 shows a scheme for an in vitro selection method. A pool of nucleic acid molecules is generated with a random core region and one or more region(s) with a defined sequence. These nucleic acid molecules are bound to a column containing immobilized oligonucleotide with a defined sequence, where the defined sequence is complementary to region(s) of defined sequence of nucleic acid molecules in the pool. Those nucleic acid molecules capable of cleaving the immobilized oligonucleotide (target) in the column are isolated and converted to complementary DNA (cDNA), followed by transcription using NTPs to form a new nucleic acid pool.

FIG. 3 shows a scheme for a two column in vitro selection method. A pool of nucleic acid molecules is generated with a random core and two flanking regions (region A and region B) with defined sequences. The pool is passed through a column which has immobilized oligonucleotides with regions A' and B' that are complementary to regions A and B of the nucleic acid molecules in the pool, respectively. The column is subjected to conditions sufficient to facilitate cleavage of the immobilized oligonucleotide target. The molecules in the pool that cleave the target (active molecules) have A' region of the target bound to their A region, whereas the B region is free. The column is washed to isolate the active molecules with the bound A' region of the target. This pool of active molecules may also contain some molecules that are not active to cleave the target (inactive molecules) but have dissociated from the column. To separate the contaminating inactive molecules from the active molecules, the pool is passed through a second column (column 2) which contains immobilized oligonucleotides with the A' sequence but not the B' sequence. The inactive molecules will bind to column 2 but the active molecules will not bind to column 2 because their A region is occupied by the A' region of the target oligonucleotide from column 1. Column 2 is washed to isolate the active molecules for further processing as described in the sceme shown in FIG. 2.

FIG. 4 is a diagram of a novel 48 nucleotide enzymatic nucleic acid motif which was identified using in vitro methods described in the instant invention. The molecule shown is only exemplary. The 5' and 3' terminal nucleotides (referring to the nucleotides of the substrate binding arms rather than merely the single terminal nucleotide on the 5' and 3' ends) can be varied so long as those portions can base-pair with target substrate sequence. In addition, the guanosine (G) shown at the cleavage site of the substrate can be changed to other nucleotides so long as the change does not eliminate the ability of enzymatic nucleic acid molecules to cleave the target sequence. Substitutions in the nucleic acid molecule and/or in the substrate sequence can be readily tested, for example, as described herein.

FIG. 5 is a schematic diagram of HCV luciferase assay used to demonstrate efficacy of class I enzymatic nucleic acid molecule motif.

FIG. 6 is a graph indicating the dose curve of an enzymatic nucleic acid molecule targeting site 146 on HCV RNA.

FIG. 7 is a bar graph showing enzymatic nucleic acid molecules targeting 4 sites within the HCV RNA are able to reduce RNA levels in cells.

FIGS. 8a and 8b show secondary structures and cleavage rates for characterized Class II enzymatic nucleic acid motifs.

FIG. 9 is a diagram of a novel 35 nucleotide enzymatic nucleic acid motif which was identified using in vitro methods described in the instant invention. The molecule shown is only exemplary. The 5' and 3' terminal nucleotides (referring to the nucleotides of the substrate binding arms rather than merely the single terminal nucleotide on the 5' and 3' ends) can be varied so long as those portions can base-pair with target substrate sequence. In addition, the guanosine (G) shown at the cleavage site of the substrate can be changed to other nucleotides so long as the change does not eliminate the ability of enzymatic nucleic acid molecules to cleave the target sequence. Substitutions in the nucleic acid molecule and/or in the substrate sequence can be readily tested, for example, as described herein.

FIG. 10 is a bar graph showing substrate specificities for Class II (zinzyme) ribozymes.

FIG. 11 is a bar graph showing Class II enzymatic nucleic acid molecules targeting 10 representative sites within the HER2 RNA in a cellular proliferation screen.

FIG. 12 is a synthetic scheme outlining the synthesis of 5-[3-aminopropynyl(propyl)]uridine 5'-triphosphates and 4-imidazoleaceticacid conjugates.

FIG. 13 is a synthetic scheme outlining the synthesis of 5-[3-(N-4-imidazoleacetyl)amimopropynyl(propyl)]uridine 5'-triphosphates.

FIG. 14 is a synthetic scheme outlining the synthesis of carboxylate tethered uridine 5'-triphosphoates.

FIG. 15 is a synthetic scheme outlining the synthesis of 5-(3-aminoalkyl) and 5-]3(N-succinyl)aminopropyl] functionalized cytidines.

FIG. 16 is a diagram of a class I ribozyme stem truncation and loop replacement analysis.

FIG. 17 is a diagram of class I ribozymes with truncated stem(s) and/or non-nucleotide linkers used in loop structures.

FIG. 18 is a diagram of "no-ribo" class II ribozymes.

FIG. 19 is a graph showing cleavage reactions with class II ribozymes under differing divalent metal concentrations.

FIG. 20 is a diagram of differing class II ribozymes with varying ribo content and their relative rates of catalysis.

NUCLEOTIDE SYNTHESIS

Addition of dimethylaminopyridine (DMAP) to the phosphorylation protocols known in the art can greatly increase the yield of nucleotide monophosphates while decreasing the reaction time (FIG. 1). Synthesis of the nucleosides of the invention have been described in several publications and Applicants previous applications (Beigelman et al., International PCT publication No. WO 96/18736; Dudzcy et al., Int. PCT Pub. No. WO 95/11910; Usman et al., Int. PCT Pub. No. WO 95/13378; Matulic-Adamic et al., 1997, *Tetrahedron Lett.* 38, 203; Matulic-Adamic et al., 1997, *Tetrahedron Lett.* 38, 1669; all of which are incorporated herein by reference). These nucleosides are dissolved in triethyl phosphate and chilled in an ice bath. Phosphorus oxychloride ($POCl_3$) is then added followed by the introduction of DMAP. The reaction is then warmed to room temperature and allowed to proceed for 5 hours. This reaction allows the formation of nucleotide monophosphates which can then be used in the formation of nucleotide triphosphates. Tributylamine is added followed by the addition of anhydrous acetonitrile and tributylammonium pyrophosphate. The reaction is then quenched with TEAB and stirred overnight at room temperature (about 20° C.). The triphosphate is purified using Sephadex® column purification or equivalent and/or HPLC and the chemical structure is confirmed using NMR analysis. Those skilled in the art will recognize that the reagents, temperatures of the reaction, and purification methods can easily be alternated with substitutes and equivalents and still obtain the desired product.

Nucleotide Triphosphates

The invention provides nucleotide triphosphates which can be used for a number of different functions. The nucleotide triphosphates formed from nucleosides found in Table I are unique and distinct from other nucleotide triphosphates known in the art. Incorporation of modified nucleotides into DNA or RNA oligonucleotides can alter the properties of the molecule. For example, modified nucleotides can hinder binding of nucleases, thus increasing the chemical half-life of the molecule. This is especially important if the molecule is to be used for cell culture or in vivo. It is known in the art that the introduction of modified nucleotides into these molecules can greatly increase the stability and thereby the effectiveness of the molecules (Burgin et al., 1996, *Biochemistry* 35, 14090–14097; Usman et al., 1996, *Curr. Opin. Struct. Biol.* 6, 527–533).

Modified nucleotides are incorporated using either wild type and mutant polymerases. For example, mutant T7 polymerase is used in the presence of modified nucleotide triphosphate(s), DNA template and suitable buffers. Those skilled in the art will recognize that other polymerases and their respective mutant versions can also be utilized for the incorporation of NTP's of the invention. Nucleic acid transcripts were detected by incorporating radiolabelled nucleotides ($\alpha^{32}P$ NTP). The radiolabeled NTP contained the same base as the modified triphosphate being tested. The effects of methanol, PEG and LiCl were tested by adding these compounds independently or in combination. Detection and quantitation of the nucleic acid transcripts was performed using a Molecular Dynamics PhosphorImager. Efficiency of transcription was assessed by comparing modified nucleotide triphosphate incorporation with all-ribonucleotide incorporation control. Wild type polymerase was used to incorporate NTP's using the manufacturer's buffers and instructions (Boehringer Mannheim).

Transcription Conditions

Incorporation rates of modified nucleotide triphosphates into oligonucleotides can be increased by adding to traditional buffer conditions, several different enhancers of modified NTP incorporation. Applicant has utilized methanol and LiCl in an attempt to increase incorporation rates of dNTP using RNA polymerase. These enhancers of modified NTP incorporation can be used in different combinations and ratios to optimize transcription. Optimal reaction conditions differ between nucleotide triphosphates and can readily be determined by standard experimentation. Overall, however, Applicant has found that inclusion of enhancers of modified NTP incorporation such as methanol or inorganic compound such as lithium chloride increase the mean transcription rates.

Mechanism of Action of Nucleic Acid Molecules of the Invention

Antisense

Antisense molecules may be modified or unmodified RNA, DNA, or mixed polymer oligonucleotides and primarily function by specifically binding to matching sequences resulting in inhibition of peptide synthesis (Wu-Pong, November 1994, *BioPharm,* 20–33). The antisense oligonucleotide binds to target RNA by Watson Crick base-pairing and blocks gene expression by preventing ribosomal translation of the bound sequences either by steric blocking or by activating RNase H enzyme. Antisense molecules may also alter protein synthesis by interfering with RNA processing or transport from the nucleus into the cytoplasm (Mukhopadhyay & Roth, 1996, *Crit. Rev. in Onicogenesis* 7, 151–190).

In addition, binding of single stranded DNA to RNA may result in nuclease degradation of the heteroduplex (Wu- Pong, supra; Crooke, supra). To date, the only backbone modified DNA chemistry which will act as substrates for RNase H are phosphorothioates and phosphorodithioates. Recently, it has been reported that 2'-arabino and 2'-fluoro arabino-containing oligos can also activate RNase H activity.

A number of antisense molecules have been described that utilize novel configurations of chemically modified nucleotides, secondary structure, and/or RNase H substrate domains (Woolf et al., International PCT Publication No. WO 98/13526; Thompson et al., U.S. S. No. 60/082,404 which was filed on Apr. 20, 1998; Hartmann et al., U.S. S. No. 60/101,174 which was filed on Sep. 21, 1998) all of these are incorporated by reference herein in their entirety.

Triplex Forming Oligonucleotides (TFO)

Single stranded DNA may be designed to bind to genomic DNA in a sequence specific manner. TFOs are comprised of pyrimidine-rich oligonucleotides which bind DNA helices through Hoogsteen Base-pairing (Wu-Pong, supra). The resulting triple helix composed of the DNA sense, DNA antisense, and TFO disrupts RNA synthesis by RNA polymerase. The TFO mechanism may result in gene expression or cell death since binding may be irreversible (Mukhopadhyay & Roth, supra)

2-5A Antisense Chimera

The 2-5A system is an interferon-mediated mechanism for RNA degradation found in higher vertebrates (Mitra et al., 1996, *Proc Nat Acad Sci USA* 93, 6780–6785). Two types of enzymes, 2-5A synthetase and RNase L, are required for RNA cleavage. The 2-5A synthetases require double stranded RNA to form 2'-5' oligoadenylates (2-5A). 2-5A then acts as an allosteric effector for utilizing RNase L which has the ability to cleave single stranded RNA. The ability to form 2-5A structures with double stranded RNA makes this system particularly useful for inhibition of viral replication.

(2'-5') oligoadenylate structures may be covalently linked to antisense molecules to form chimeric oligonucleotides capable of RNA cleavage (Torrence, supra). These molecules putatively bind and activate a 2-5A dependent RNase, the oligonucleotide/enzyme complex then binds to a target RNA molecule which can then be cleaved by the RNase enzyme.

Enzymatic Nucleic Acid

In general, enzymatic nucleic acids act by first binding to a target RNA. Such binding occurs through the target-binding portion of an enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of an enzymatic nucleic acid has significant advantages, such as the concentration of enzymatic nucleic acid molecules necessary to affect a therapeutic treatment is lower. This advantage reflects the ability of the enzymatic nucleic acid molecules to act enzymatically. Thus, a single enzymatic nucleic acid molecule is able to cleave many molecules of target RNA. In addition, the enzymatic nucleic acid molecule is a highly specific inhibitor, with the specificity of inhibition depending not only on the base-pairing mechanism of binding to the target RNA, but also on the mechanism of target RNA cleavage. Single mismatches, or base-substitutions, near the site of cleavage can be chosen to completely eliminate catalytic activity of enzymatic nucleic acid molecules.

Nucleic acid molecules having an endonuclease enzymatic activity are able to repeatedly cleave other separate RNA molecules in a nucleotide base sequence-specific manner. Such enzymatic nucleic acid molecules can be targeted to virtually any RNA transcript, and efficient cleavage achieved in vitro (Zaug et al., 324, *Nature* 429 1986; Uhlenbeck, 1987 *Nature* 328, 596; Kim et al., 84 *Proc. Natl. Acad. Sci. USA* 8788, 1987; Dreyfus, 1988, *Einstein Quart. J. Bio. Med.,* 6, 92; Haseloff and Gerlach, 334 *Nature* 585, 1988; Cech, 260 *JAMA* 3030, 1988; and Jefferies et al., 17 *Nucleic Acids Research* 1371, 1989; Santoro et al., 1997 infra).

Because of their sequence-specificity, trans-cleaving enzymatic nucleic acid molecules show promise as therapeutic agents for human disease (Usman & McSwiggen, 1995 *Ann. Rep. Med. Chem.* 30, 285–294; Christoffersen and Marr, 1995 *J. Med. Chem.* 38, 2023–2037). Enzymatic nucleic acid molecules can be designed to cleave specific RNA targets within the background of cellular RNA. Such a cleavage event renders the RNA non-functional and abrogates protein expression from that RNA. In this manner, synthesis of a protein associated with a disease state can be selectively inhibited.

Synthesis of Nucleic Acid Molecules

Synthesis of nucleic acids greater than 100 nucleotides in length is difficult using automated methods, and the therapeutic cost of such molecules is prohibitive. In this invention, small nucleic acid motifs ("small refers to nucleic acid motifs no more than 100 nucleotides in length, preferably no more than 80 nucleotides in length, and most preferably no more than 50 nucleotides in length; e.g., antisense oligonucleotides, hammerhead or the hairpin ribozymes) are preferably used for exogenous delivery. The simple structure of these molecules increases the ability of the nucleic acid to invade targeted regions of RNA structure. Exemplary molecules of the instant invention were chemically synthesized, and others can similarly be synthesized.

Oligodeoxyribonucleotides were synthesized using standard protocols as described in Caruthers et al., 1992, *Methods in Enzymology* 211, 3–19.

The method of synthesis used for normal RNA including certain enzymatic nucleic acid molecules follows the procedure as described in Usman et al., 1987, *J. Am. Chem. Soc.,* 109, 7845; Scaringe et al., 1990, *Nucleic Acids Res.,* 18, 5433; and Wincott et al., 1995, *Nucleic Acids Res.* 23, 2677–2684 Wincott et al., 1997, *Methods Mol. Bio.,* 74, 59, and makes use of common nucleic acid protecting and coupling groups, such as dimethoxytrityl at the 5'-end, and phosphoramidites at the 3'-end. In a non-limiting example, small scale syntheses were conducted on a 394 Applied Biosystems, Inc. synthesizer using a 0.2 $\mu$mol scale protocol with a 7.5 min coupling step for alkylsilyl protected nucleotides and a 2.5 min coupling step for 2'-O-methylated nucleotides. Table II outlines the amounts and the contact times of the reagents used in the synthesis cycle. Alternatively, syntheses at the 0.2 $\mu$mol scale can be done on a 96-well plate synthesizer, such as the instrument produced by Protogene (Palo Alto, Calif.) with minimal modification to the cycle. A 33-fold excess (60 $\mu$L of 0.11 M=6.6 $\mu$mol) of 2'-O-methyl phosphoramidite and a 75-fold excess of S-ethyl tetrazole (60 $\mu$L of 0.25 M=15 $\mu$mol) can be used in each coupling cycle of 2'-O-methyl residues relative to polymer-bound 5'-hydroxyl. A 66-fold excess (120 $\mu$L of 0.11 M=13.2 $\mu$mol) of alkylsilyl (ribo) protected phosphoramidite and a 150-fold excess of S-ethyl tetrazole (120 μL of 0.25 M=30 μmol) can be used in each coupling cycle of ribo residues relative to polymer-bound 5'-hydroxyl. Average coupling yields on the 394 Applied Biosystems, Inc. synthesizer, determined by colorimetric quantitation of the trityl fractions, were 97.5–99%. Other oligonucleotide synthesis reagents for the 394 Applied Biosystems, Inc. synthesizer; detritylation solution was 3% TCA in methylene chloride (ABI); capping was performed with 16% N-methyl imidazole in THF (ABI) and 10% acetic anhydride/10% 2,6-lutidine in THF (ABI); oxidation solution was 16.9 mM $I_2$, 49 mM pyrdine, 9% water in THF (PERSEPTIVE™). Burdick & Jackson Synthesis Grade acetonitrile was used directly from the reagent bottle. S-Ethyltetrazole solution (0.25 M in acetonitrile) was made up from the solid obtained from American International Chemical, Inc.

Deprotection of the RNA was performed using either a two-pot or one-pot protocol. For the two-pot protocol, the polymer-bound trityl-on oligoribonucleotide was transferred to a 4 mL glass screw top vial and suspended in a solution of 40% aq. methylamine (1 mL) at 65° C. for 10 min. After cooling to −20° C., the supernatant was removed from the polymer support. The support was washed three times with 1.0 mL of EtOH:MeCN:H2O/3:1:1, vortexed and the supernatant was then added to the first supernatant. The combined supernatants, containing the oligoribonucleotide, were dried to a white powder. The base deprotected oligoribonucleotide was resuspended in anhydrous TEA/HF/NMP solution (300 μL of a solution of 1.5 mL N-methylpyrrolidinone, 750 μL TEA and 1 mL TEA.3HF to provide a 1.4 M HF concentration) and heated to 65° C. After 1.5 h, the oligomer was quenched with 1.5 M $NH_4HCO_3$.

Alternatively, for the one-pot protocol, the polymer-bound trityl-on oligoribonucleotide was transferred to a 4 mL glass screw top vial and suspended in a solution of 33% ethanolic methylamine/DMSO: 1/1 (0.8 mL) at 65° C. for 15 min. The vial was brought to r.t. TEA.3HF (0.1 mL) was added and the vial was heated at 65° C. for 15 min. The sample was cooled at −20° C. and then quenched with 1.5 M $NH_4HCO_3$.

For purification of the trityl-on oligomers, the quenched $NH_4HCO_3$ solution was loaded onto a C-18 containing cartridge that had been prewashed with acetonitrile followed by 50 mM TEAA. After washing the loaded cartridge with water, the RNA was detritylated with 0.5% TFA for 13 min. The cartridge was then washed again with water, salt exchanged with 1 M NaCl and washed with water again. The oligonucleotide was then eluted with 30% acetonitrile.

Inactive hammerhead ribozymes or binding attenuated control (BAC) oligonucleotides) were synthesized by substituting a U for $G_5$ and a U for $A_{14}$ (numbering from Hertel, K. J., et al., 1992, *Nucleic Acids Res.*, 20, 3252). Similarly, one or more nucleotide substitutions can be introduced in other enzymatic nucleic acid molecules to inactivate the molecule and such molecules can serve as a negative control.

The average stepwise coupling yields were >98% (Wincott et al., 1995 *Nucleic Acids Res.* 23, 2677–2684). Those of ordinary skill in the art will recognize that the scale of synthesis can be adapted to be larger or smaller than the example described above including but not limited to 96-well format, all that is important is the ratio of chemicals used in the reaction.

Alternatively, the nucleic acid molecules of the present invention can be synthesized separately and joined together post-synthetically, for example by ligation (Moore et al., 1992, *Science* 256, 9923; Draper et al., International PCT publication No. WO 93/23569; Shabarova et al., 1991, *Nucleic Acids Research* 19, 4247; Bellon et al., 1997, *Nucleosides & Nucleotides*, 16, 951; Bellon et al., 1997, *Bioconjugate Chem.* 8, 204).

The nucleic acid molecules of the present invention are modified extensively to enhance stability by modification with nuclease resistant groups, for example, 2'-amino, 2'-C-allyl, 2'-flouro, 2'-O-methyl, 2'-H (for a review see Usman and Cedergren, 1992, *TIBS* 17, 34; Usman et al., 1994, *Nucleic Acids Symp. Ser.* 31, 163). Ribozymes are purified by gel electrophoresis using general methods or are purified by high pressure liquid chromatography (HPLC; See Wincott et al., supra, the totality of which is hereby incorporated herein by reference) and are re-suspended in water.

The sequences of the ribozymes and antisense constructs that are chemically synthesized, useful in this study, are shown in Tables XII to XV. Those in the art will recognize that these sequences are representative only of many more such sequences where the enzymatic portion of the ribozyme (all but the binding arms) is altered to affect activity. The ribozyme and antisense construct sequences listed in Tables XII to XV may be formed of ribonucleotides or other nucleotides or non-nucleotides. Such ribozymes with enzymatic activity are equivalent to the ribozymes described specifically in the Tables.

Optimizing Nucleic Acid Catalyst Activity

Catalytic activity of the enzymatic nucleic acid molecules described and identified using the methods of the instant invention, can be optimized as described by Draper et al., supra and using the methods well known in the art. The details will not be repeated here, but include altering the length of the enzymatic nucleic acid molecules' binding arms, or chemically synthesizing enzymatic nucleic acid molecules with modifications (base, sugar and/or phosphate) that prevent their degradation by serum ribonucleases and/or enhance their enzymatic activity (see e.g., Eckstein et al., International Publication No. WO 92/07065; Perrault et al., 1990 *Nature* 344, 565; Pieken et al., 1991 *Science* 253, 314; Usman and Cedergren, 1992 *Trends in Biochem. Sci.* 17, 334; Usman et al., International Publication No. WO 93/15187; Rossi et al., International Publication No. WO 91/03162; Sproat, U.S. Pat. No. 5,334,711; and Burgin et al., supra; all of these describe various chemical modifications that can be made to the base, phosphate and/or sugar moieties of enzymatic nucleic acid molecules). All U.S. Patents cited publications are hereby incorporated by reference herein. Modifications which enhance their efficacy in cells, and removal of bases from stem loop structures to shorten synthesis times and reduce chemical requirements are desired.

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-flouro, 2'-O-methyl, 2'-H, nucleotide base modifications (for a review see Usman and Cedergren, 1992, *TIBS.* 17, 34; Usman et al., 1994, *Nucleic Acids Symp. Ser.* 31, 163; Burgin al., 1996, *Biochemistry*, 35, 14090). Sugar modification of nucleic acid molecules have been extensively described in the art (see Eckstein et al., International Publication PCT No. WO 92/07065; Perrault et al. *Nature*, 1990, 344, 565–568; Pieken et al. *Science*, 1991, 253, 314–317; Usman and Cedergren, *Trends in Biochem. Sci.*, 1992, 17, 334–339; Usman et al. International Publication PCT No. WO 93/15187; Sproat, U.S. Pat. No. 5,334,711 and Beigelman et al., 1995, *J. Biol. Chem.*, 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. S. No. 60/082,404 which was filed on Apr. 20, 1998; Karpeisky et al., 1998, *Tetrahedron Lett.*, 39, 1131; Earnshaw and Gait, 1998, *Biopolymers* (*Nucleic acid Sciences*), 48, 39–55; Verma and Eckstein, 1998, *Annu. Rev. Biochem.*, 67, 99–134; and Burlina et al., 1997, *Bioorg. Med. Chem.*, 5, 1999–2010; all U.S. Patents cited are hereby incorporated by reference herein in their totalities). Such publications describe general methods and strategies to determine the location of incorporation of sugar, base and/or phosphate modifications and the like into ribozymes without inhibiting catalysis, and are incorporated by reference herein. In view of such teachings, similar modifications can be used as described herein to modify the nucleic acid molecules of the instant invention.

While chemical modification of oligonucleotide internucleotide linkages with phosphorothioate, phosphorodithioate, and/or 5'-methylphosphonate linkages improves stability, too many of these modifications may cause some toxicity. Therefore, when designing nucleic acid molecules, the amount of these internucleotide linkages should be minimized, but can be balanced to provide acceptable stability while reducing potential toxicity. The reduction in the concentration of these linkages should lower toxicity resulting in increased efficacy and higher specificity of these molecules.

Nucleic acid catalysts having chemical modifications which maintain or enhance enzymatic activity are provided. Such nucleic acid molecules are generally more resistant to nucleases than unmodified nucleic acid. Thus, in a cell and/or in vivo the activity may not be significantly lowered. As exemplified herein, such enzymatic nucleic acid molecules are useful in a cell and/or in vivo even if activity over all is reduced 10-fold (Burgin et al., 1996, *Biochemistry*, 35, 14090). Such enzymatic nucleic acid molecules herein are said to "maintain" the enzymatic activity.

Therapeutic nucleic acid molecules (e.g., enzymatic nucleic acid molecules and antisense nucleic acid molecules) delivered exogenously must optimally be stable within cells until translation of the target RNA has been inhibited long enough to reduce the levels of the undesirable protein. This period of time varies between hours to days depending upon the disease state. Clearly, these nucleic acid molecules must be resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

By "enhanced enzymatic activity" is meant to include activity measured in cells and/or in vivo where the activity is a reflection of both catalytic activity and enzymatic nucleic acid molecules stability. In this invention, the product of these properties is increased or not significantly (less than 10-fold) decreased in vivo compared to unmodified enzymatic nucleic acid molecules.

In yet another preferred embodiment, nucleic acid catalysts having chemical modifications which maintain or enhance enzymatic activity are provided. Such nucleic acid is also generally more resistant to nucleases than unmodified nucleic acid. Thus, in a cell and/or in vivo the activity may not be significantly lowered. As exemplified herein such enzymatic nucleic acid molecules are useful in a cell and/or in vivo even if activity over all is reduced 10-fold (Burgin et al, 1996, *Biochemistry*, 35, 14090). Such enzymatic nucleic acid molecules herein are said to "maintain" the enzymatic activity on all RNA enzymatic nucleic acid molecule.

Use of these molecules will lead to better treatment of the disease progression by affording the possibility of combination therapies (e.g., multiple enzymatic nucleic acid molecules targeted to different genes, enzymatic nucleic acid molecules coupled with known small molecule inhibitors, or intermittent treatment with combinations of enzymatic nucleic acid molecules (including different enzymatic nucleic acid molecules motifs) and/or other chemical or biological molecules). The treatment of patients with nucleic acid molecules may also include combinations of different types of nucleic acid molecules. Therapies may be devised which include a mixture of enzymatic nucleic acid molecules (including different enzymatic nucleic acid molecules motifs), antisense and/or 2-5A chimera molecules to one or more targets to alleviate symptoms of a disease.

Administration of Nucleotide Mono, Di or Triphosphates and Nucleic Acid Molecules Methods for the delivery of nucleic acid molecules are described in Akhtar et al., 1992, *Trends Cell Bio.*, 2, 139; and *Delivery Strategies for Antisense Oligonucleotide Therapeutics*, ed. Akhtar, 1995. Sullivan et al, PCT WO 94/02595, further describes the general methods for delivery of enzymatic RNA molecules. These protocols may be utilized for the delivery of virtually any nucleic acid molecule. Nucleic acid molecules may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, nucleic acid molecules may be directly delivered ex vivo to cells or tissues with or without the aforementioned vehicles. Alternatively, the nucleic acid/vehicle combination is locally delivered by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of nucleic acid delivery and administration are provided in Sullivan et al., supra, Draper et al., PCT WO93/23569, Beigelman et al., PCT WO99/05094, and Klimuk et al., PCT WO99/04819.

The molecules of the instant invention can be used as pharmaceutical agents. Pharmaceutical agents prevent, inhibit the occurrence, or treat (alleviate a symptom to some extent, preferably all of the symptoms) of a disease state in a patient.

The negatively charged nucleotide mono, di or triphosphates of the invention can be administered and introduced into a patient by any standard means, with or without stabilizers, buffers, and the like, to form a pharmaceutical composition. When it is desired to use a liposome delivery mechanism, standard protocols for formation of liposomes can be followed. The compositions of the present invention may also be formulated and used as tablets, capsules or elixirs for oral administration; suppositories for rectal administration; sterile solutions; suspensions for injectable administration; and the like.

The present invention also includes pharmaceutically acceptable formulations of the compounds described. These formulations include salts of the above compounds, e.g., ammonium, sodium, calcium, magnesium, lithium, tributylammoniun, and potassium salts.

A pharmacological composition or formulation refers to a composition or formulation in a form suitable for administration, e.g., systemic administration, into a cell or patient, preferably a human. Suitable forms, in part, depend upon the use or the route of entry, for example oral, transdermal, or by injection. Such forms should not prevent the composition or formulation to reach a target cell (i.e., a cell to which the negatively charged polymer is desired to be delivered to). For example, pharmacological compositions injected into the blood stream should be soluble. Other factors are known in the art, and include considerations such as toxicity and forms which prevent the composition or formulation from exerting its effect.

By "systemic administration" is meant in vivo systemic absorption or accumulation of drugs in the blood stream followed by distribution throughout the entire body. Administration routes which lead to systemic absorption include, without limitations: intravenous, subcutaneous, intraperitoneal, inhalation, oral, intrapulmonary and intramuscular. Each of these administration routes expose the desired negatively charged polymers, e.g., NTP's, to an accessible diseased tissue. The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation which can facilitate the association of drug with the surface of cells, such as, lymphocytes and macrophages is also useful. This approach may provide enhanced delivery of the drug to target cells by taking advantage of the specificity of macrophage and lymphocyte immune recognition of abnormal cells, such as cancer cells.

The invention also features the use of a composition comprising surface-modified liposomes containing poly (ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev.* 1995, 95, 2601–2627; Ishiwata et al., *Chem. Pharm. Bull.* 1995, 43, 1005–1011). Such liposomes have been shown to accumulate selectively in tumors, presumably by extravasation and capture in the neovascularized target tissues (Lasic et al., *Science* 1995, 267, 1275–1276; Oku et al., 1995, *Biochim. Biophys. Acta,* 1238, 86–90). The long-circulating liposomes enhance the pharmacokinetics and pharmacodynamics of drugs, particularly compared to conventional cationic liposomes which are known to accumulate in tissues of the MPS (Liu et al., *J. Biol. Chem.* 1995, 42, 24864–24870; Choi et al., International PCT Publication No. WO 96/10391; Ansell et al., International PCT Publication No. WO 96/10390; Holland et al., International PCT Publication No. WO 96/10392). Long-circulating liposomes are also likely to protect drugs from nuclease degradation to a greater extent compared to cationic liposomes, based on their ability to avoid accumulation in metabolically aggressive MPS tissues, such as the liver and spleen.

The present invention also includes compositions prepared for storage or administration which include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences*, Mack Publishing Co. (A. R. Gennaro edit. 1985). For example, preservatives, stabilizers, dyes and flavoring agents may be provided. Id. at 1449. These include sodium benzoate, sorbic acid and esters of p-hydroxybenzoic acid. In addition, antioxidants and suspending agents may be used.

By "patient" is meant an organism which is a donor or recipient of explanted cells or the cells themselves. "Patient" also refers to an organism to which the compounds of the invention can be administered. Preferably, a patient is a mammal, e.g., a human, primate or a rodent.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors which those skilled in the medical arts will recognize. Generally, an amount between 0.1 mg/kg and 100 mg/kg body weight/day of active ingredients is administered dependent upon potency of the negatively charged polymer. In a one aspect, the invention provides enzymatic nucleic acid molecules that can be delivered exogenously to specific cells as required.

The nucleic acid molecules of the present invention may also be administered to a patient in combination with other therapeutic compounds to increase the overall therapeutic effect. The use of multiple compounds to treat an indication may increase the beneficial effects while reducing the presence of side effects.

EXAMPLES

The following are non-limiting examples showing the synthesis, incorporation and analysis of nucleotide triphosphates and activity of enzymatic nucleic acids of the instant invention.

Applicant synthesized pyrimidine nucleotide triphosphates using DMAP in the reaction. For purines, applicant utilized standard protocols previously described in the art (Yoshikawa et al supra;. Ludwig, supra). Described below is one example of a pyrimdine nucleotide triphosphate and one purine nucleotide triphosphate synthesis.

Example 1

Synthesis of Purine Nucleotide Triphosphates: 2'-O-methyl-guanosine-5'-triphosphate 2'-O-methyl guanosine nucleoside (0.25 grams, 0.84 mmol) was dissolved in triethyl phosphate (5.0) ml by heating to 100° C. for 5 minutes. The resulting clear, colorless solution was cooled to 0° C. using an ice bath under an argon atmosphere. Phosphorous oxychloride (1.8 eq., 0.141 ml) was then added to the reaction mixture with vigorous stirring. The reaction was monitored by HPLC, using a sodium perchlorate gradient. After 5 hours at 0° C., tributylamine (0.65 ml) was added followed by the addition of anhydrous acetonitrile (10.0 ml), and after 5 minutes (reequilibration to 0° C.) tributylammonium pyrophosphate (4.0 eq., 1.53 g) was added. The reaction mixture was quenched with 20 ml of 2M TEAB after 15 minutes at 0° C. (HPLC analysis with above conditions showed consumption of monophosphate at 10 minutes) then stirred overnight at room temperature, the mixture was evaporated in vacuo with methanol co-evaporation 4x) then diluted in 50 ml 0.05M TEAB. DEAE sephadex purification was used with a gradient of 0.05 to 0.6 M TEAB to obtain pure triphosphate (0.52 g, 66.0% yield) (elutes around 0.3M TEAB); the purity was confirmed by HPLC and NMR analysis.

Example 2

Synthesis of Pyrimdine Nucleotide Triphosphates: 2'-O-methylthiomethyl-uridine-5'-triphosphate 2'-O-methylthiomethyl uridine nucleoside (0.27 grams, 1.0 mmol) was dissolved in triethyl phosphate (5.0 ml). The resulting clear, colorless solution was cooled to 0° C. with an ice bath under an argon atmosphere. Phosphorus oxychloride (2.0 eq., 0.190 ml) was then added to the reaction mixture with vigorous stirring. Dimethylaminopyridine (DMAP, 0.2 eq., 25 mg) was added, the solution warmed to room temperature and the reaction was monitored by HPLC, using a sodium perchlorate gradient. After 5 hours at 20° C. tributylamine (1.0 ml) was added followed by anhydrous acetonitrile (10.0 ml), and after 5 minutes tributylammonium pyrophosphate (4.0 eq., 1.8 g) was added. The reaction mixture was quenched with 20 ml of 2M TEAB after 15 minutes at 20° C. (HPLC analysis with above conditions showed consumption of monophosphate at 10 minutes) then stirred overnight at room temperature. The mixture was evaporated in vacuo with methanol co-evaporation 4x) then diluted in 50 ml 0.05M TEAB. DEAE fast flow Sepharose purification with a gradient of 0.05 to 1.0 M TEAB was used to obtain pure triphosphate (0.40 g, 44% yield) (elutes around 0.3M TEAB) as determined by HPLC and NMR analysis.

Example 3

Utilization of DMAP in Uridine 5'-Triphosphate Synthesis

The reactions were performed on 20 mg aliquots of nucleoside dissolved in 1 ml of triethyl phosphate and 19 ul of phosphorus oxychloride. The reactions were monitored at 40 minute intervals automatically by HPLC to generate yield-of-product curves at times up to 18 hours. A reverse phase column and ammonium acetate/sodium acetate buffer system (50 mM & 100 mM respectively at pH 4.2) was used to separate the 5', 3', 2' monophosphates (the monophosphates elute in that order) from the 5'-triphosphate and the starting nucleoside. The data is shown in Table III. These conditions doubled the product yield and resulted in a 10-fold improvement in the reaction time to maximum yield (1200 minutes down to 120 minutes for a 90% yield). Selectivity for 5'-monophosphorylation was observed for all reactions. Subsequent triphosphorylation occurred in nearly quantitative yield.

Materials used in Bacteriophage T7 RNA Polymerase Reactions

Buffer 1: Reagents are mixed together to form a 10xstock solution of buffer 1 (400 mM Tris-Cl [pH 8.1], 200 mM MgCl$_2$, 100 mM DTT, 50 mM spermidine, and 0.1% triton® X-100). Prior to initiation of the polymerase reaction methanol, LiCl is added and the buffer is diluted such that the final reaction conditions for condition 1 consisted of: 40 mM tris (pH 8.1), 20 mM MgCl$_2$, 10 mM DTT, 5 mM spermidine, 0.01% triton® X-100, 10% methanol, and 1 mM LiCl.

BUFFER 2: Reagents are mixed together to form a 10xstock solution of buffer 2 (400 mM Tris-Cl [pH 8.1], 200 mM MgCl$_2$, 100 mM DTT, 50 mM spermidine, and 0.1% triton® X-100). Prior to initiation of the polymerase reaction PEG, LiCl is added and the buffer is diluted such that the final reaction conditions for buffer 2 consisted of: 40 mM tris (pH 8.1), 20 mM MgCl$_2$, 10 mM DTT, 5 mM spermidine, 0.01% triton® X-100, 4% PEG, and 1 mM LiCl.

BUFFER 3: Reagents are mixed together to form a 10xstock solution of buffer 3 (400 mM Tris-Cl [pH 8.0], 120 mM MgCl$_2$, 50 mM DTT, 10 mM spermidine and 0.02% triton® X-100). Prior to initiation of the polymerase reaction PEG is added and the buffer is diluted such that the final reaction conditions for buffer 3 consisted of: 40 mM tris (pH 8.0), 12 mM MgCl$_2$, 5 mM DTT, 1 mM spermidine, 0.002% triton® X-100, and 4% PEG.

BUFFER 4: Reagents are mixed together to form a 1033 stock solution of buffer 4 (400 mM Tris-Cl [pH 8.0], 120 mM MgCl$_2$, 50 mM DTT, 10 mM spermidine and 0.02% triton® X-100). Prior to initiation of the polymerase reaction PEG, methanol is added and the buffer is diluted such that the final reaction conditions for buffer 4 consisted of: 40 mM tris (pH 8.0), 12 mM MgCl$_2$, 5 mM DTT, 1 mM spermidine, 0.002% triton® X-100, 10% methanol, and 4% PEG.

BUFFER 5: Reagents are mixed together to form a 10xstock solution of buffer 5 (400 mM Tris-Cl [pH 8.0], 120 mM MgCl$_2$, 50 mM DTT, 10 mM spermidine and 0.02% triton® X-100). Prior to initiation of the polymerase reaction PEG, LiCl is added and the buffer is diluted such that the final reaction conditions for buffer 5 consisted of: 40 mM tris (pH 8.0), 12 mM MgCl$_2$, 5 mM DTT, 1 mM spermidine, 0.002% triton® X-100, 1 mM LiCl and 4% PEG.

BUFFER 6: Reagents are mixed together to form a 10xstock solution of buffer 6 (400 mM Tris-Cl [pH 8.0], 120 mM MgCl$_2$, 50 mM DTT, 10 mM spermidine and 0.02% triton® X-100). Prior to initiation of the polymerase reaction PEG, methanol is added and the buffer is diluted such that the final reaction conditions for buffer 6 consisted of: 40 mM tris (pH 8.0), 12 mM MgCl$_2$, 5 mM DTT, 1 mM spermidine, 0.002% triton® X-100, 10% methanol, and 4% PEG.

BUFFER 7: Reagents are mixed together to form a 10xstock solution of buffer 6 (400 mM Tris-Cl [pH 8.0], 120 mM MgCl$_2$, 50 mM DTT, 10 mM spermidine and 0.02% triton® X-100). Prior to initiation of the polymerase reaction PEG, methanol and LiCl is added and the buffer is diluted such that the final reaction conditions for buffer 6 consisted of: 40 mM tris (pH 8.0), 12 mM MgCl$_2$, 5 mM DTT, 1 mM spermidine, 0.002% triton® X-100, 10% methanol, 4% PEG, and 1 mM LiCl.

Example 4

Screening of Modified Nucleotide Triphosphates with Mutant T7 RNA Polymerase

Modified nucleotide triphosphates were tested in buffers 1 through 6 at two different temperatures (25 and 37° C.). Buffers 1–6 tested at 25° C. were designated conditions 1–6 and buffers 1–6 tested at 37° C. were designated conditions 7–12 (Table IV). In each condition, Y639F mutant T7 polymerase (Sousa and Padilla, supra) (0.3–2 mg/20 ml reaction), NTP's (2 mM each), DNA template (10 pmol), inorganic pyrophosphatase (5 U/ml) and $\alpha$-$^{32}$P NTP (0.8 mCi/pmol template) were combined and heated at the designated temperatures for 1–2 hours. The radiolabeled NTP used was different from the modified triphosphate being testing. The samples were resolved by polyacrylamide gel electrophoresis. Using a phosphorImager (Molecular Dynamics, Sunnyvale, Calif.), the amount of full-length transcript was quantified and compared with an all-RNA control reaction. The data is presented in Table V; results in each reaction are expressed as a percent compared to the all-ribonucleotide triphosphate (rNTP) control. The control was run with the mutant T7 polymerase using commercially available polymerase buffer (Boehringer Mannheim, Indianapolis, Ind.).

Example 5

Incorporation of Modified NTP's Using Wild-type T7 RNA Polymerase

Bacteriophage T7 RNA polymerase was purchased from Boehringer Mannheim at 0.4 U/μL concentration. Applicant used the commercial buffer supplied with the enzyme and 0.2 μCi alpha-$^{32}$P NTP in a 50 μL reaction with nucleotides triphosphates at 2 mM each. The template was a double-stranded PCR fragment, which was used in previous screens. Reactions were carried out at 37° C. for 1 hour. Ten μL of the sample was run on a 7.5% analytical PAGE and bands were quantitated using a PhosphorImager. Results are calculated as a comparison to an "all ribo" control (non-modified nucleotide triphosphates) and the results are in Table VI.

Example 6

Incorporation of Multiple Modified Nucleotide Triphosphates into Oligonucleotides Combinations of modified nucleotide triphosphates were tested with the transcription protocol described in example 4, to determine the rates of incorporation of two or more of these triphosphates. Incorporation of 2'-Deoxy-2'-(L-histidine)amino uridine (2'-his-NH$_2$-UTP) was tested with unmodified cytidine nucleotide triphosphates, rATP and rGTP in reaction condition number 9. The data is presented as a percentage of incorporation of modified NTP's compared to the all rNTP control and is shown in Table VII a.

Two modified cytidines (2'-NH$_2$-CTP or 2'dCTP) were incorporated along with 2'-his-NH$_2$-UTP with identical efficiencies. 2'-his-NH$_2$-UTP and 2'-NH$_2$-CTP were then tested with various unmodified and modified adenosine triphosphates in the same buffer (Table VII b). The best modified adenosine triphosphate for incorporation with both 2'-his-NH$_2$-UTP and 2'-NH$_2$-CTP was 2'-NH$_2$-DAPTP.

Example 7

Optimization of Reaction Conditions for Incorporation of Modified Nucleotide Triphosphate The combination of 2'-his-NH$_2$-UTP, 2'-NH$_2$-CTP, 2'-NH$_2$-DAP, and rGTP was tested in several reaction conditions (Table VIII) using the incorporation protocol described in example 9. The results demonstrate that of the buffer conditions tested, incorporation of these modified nucleotide triphosphates occur in the presence of both methanol and LiCl.

Example 8

Selection of Novel Enzymatic Nucleic Acid Molecule Motifs Using 2'-deoxy-2'amino Modified GTP and CTP For selection of new enzymatic nucleic acid molecule motifs, pools of enzymatic nucleic acid molecules were designed to have two substrate binding arms (5 and 16 nucleotides long) and a random region in the middle. The substrate has a biotin on the 5' end, 5 nucleotides complementary to the short binding arm of the pool, an unpaired G (the desired cleavage site), and 16 nucleotides complementary to the long binding arm of the pool. The substrate was bound to column resin through an avidin-biotin complex. The general process for selection is shown in FIG. 2. The protocols described below represent one possible method that may be utilized for selection of enzymatic nucleic acid molecules and are given as a non-limiting example of enzymatic nucleic acid molecule selection with combinatorial libraries.

Construction of Libraries

The oligonucleotides listed below were synthesized by Operon Technologies (Alameda, Calif.). Templates were gel purified and then run through a Sep-Pak™ cartridge (Waters, Millford, Mass.) using the manufacturers protocol. Primers (MST3, MST7c, MST3del) were used without purification.

Primers

MST3 (30 mer): 5'-CAC TTA GCA TTA ACC CTC ACT AAA GGC CGT-3' (SEQ ID NO: 1521)
MST7c (33 mer): 5'-TAA TAC GAC TCA CTA TAG GAA AGG TGT GCA ACC-3' (SEQ ID NO: 1522)
MST3del (18 mer): 5'-ACC CTC ACT AAA GGC CGT-3' (SEQ ID NO: 1526)

Templates

MSN60c (93 mer): 5'-ACC CTC ACT AAA GGC CGT (N)$_{60}$ GGT TGC ACA CCT TTG-3' (SEQ ID NO: 1524)
MSN40c (73 mer): 5'-ACC CTC ACT AAA GGC CGT (N)$_{40}$ GGT TGC ACA CCT TTG-3' (SEQ ID NO: 1520)
MSN20c (53 mer): 5'-ACC CTC ACT AAA GGC CGT (N)$_{20}$ GGT TGC ACA CCT TTG-3' (SEQ ID NO: 1525)

N60 library was constructed using MSN60c as a template and MST3/MST7c as primers. N40 and N20 libraries were constructed using MSN40c (or MSN20c) as template and MST3del/MST7c as primers.

Single-stranded templates were converted into double-stranded DNA by the following protocol: 5 nmol template, 10 nmol each primer, in 10 ml reaction volume using standard PCR buffer, dNTP's, and taq DNA polymerase (all reagents from Boehringer Mannheim). Synthesis cycle conditions were 94° C., 4 minutes; (94° C., 1 minute; 42° C., 1 minute; 72° C., 2 minutes)×4; 72° C., 10 minutes. Products were checked on agarose gel to confirm the length of each fragment (N60=123 bp, N40=91 bp, N20=71 bp) and then were phenol/chloroform extracted and ethanol precipitated. The concentration of the double-stranded product was 25 μM.

Transcription of the initial pools was performed in a 1 ml volume comprising: 500 pmol double-stranded template (3×10$^{14}$ molecules), 40 mM tris-HCl (pH 8.0), 12 mM MgCl$_2$, 1 mM spermidine, 5 mM DTT, 0.002% triton X-100, 1 mM LiCl, 4% PEG 8000, 10% methanol, 2 mM ATP (Pharmacia), 2 mM GTP (Pharmacia), 2 mM 2'-deoxy-2'-amino-CTP (USB), 2 mM 2'-deoxy-2'-amino-UTP (USB), 5 U/ml inorganic pyrophosphatase (Sigma), 5 U/μl T7 RNA polymerase (USB; Y639F mutant was used in some cases at 0.1 mg/ml (Sousa and Padilla, supra)), 37° C., 2 hours. Transcribed libraries were purified by denaturing PAGE (N60=106 ntds, N40=74, N20=54) and the resulting product was desalted using Sep-Pak™ columns and then ethanol precipitated.

Initial Column-Selection

The following biotinylated substrate was synthesized using standard protocols (Usman et aL, 1987 *J. Am. Chem. Soc.,* 109, 7845; Scaringe et al., 1990 *Nucleic Acids Res.,* 18, 5433; and Wincott et al., 1995 *Nucleic Acids Res.* 23, 2677–2684):

5'-biotin-C18 spacer-GCC GUG GGU UGC ACA CCU UUC C-C18 spacer-thiol-modifier C6 S-S-inverted abasic-3' (SEQ ID NO: 1523)

Substrate was purified by denaturing PAGE and ethanol precipitated. 10 nmol of substrate was linked to a NeutrAvidin™ column using the following protocol: 400 µl UltraLink Immobilized NeutrAvidin™ slurry (200 µl beads, Pierce, Rockford, Ill.) were loaded into a polystyrene column (Pierce). The column was washed twice with 1 ml of binding buffer (20 mM NaPO$_4$ (pH 7.5), 150 mM NaCl) and then capped off (i.e., a cap was put on the bottom of the column to stop the flow). 200 µl of the substrate suspended in binding buffer was applied and allowed to incubate at room temperature for 30 minutes with occasional vortexing to ensure even linking and distribution of the solution to the resin. After the incubation, the cap was removed and the column was washed with 1 ml binding buffer followed by 1 ml column buffer (50 mM tris-HCL (pH 8.5), 100 mM NaCl, 50 mM KCl). The column was then ready for use and capped off. 1 nmol of the initial pool RNA was loaded on the column in a volume of 200 µl column buffer. It was allowed to bind the substrate by incubating for 30 minutes at room temperature with occasional vortexing. After the incubation, the cap was removed and the column was washed twice with 1 ml column buffer and capped off. 200 µl of elution buffer (50 mM tris-HCl (pH 8.5), 100 mM NaCl, 50 mM KCl, 25 mM MgCl$_2$) was applied to the column followed by 30 minute incubation at room temperature with occasional vortexing. The cap was removed and four 200 µl fractions were collected using elution buffer.

Second Column (Counter Selection)

A diagram for events in the second column is generally shown in FIG. 3 and substrate oligonucleotide used is shown below (SEQ ID NO: 1516):

5'-GGU UGC ACA CCU UUC C-C18 spacer-biotin-inverted abasic-3'

This column substrate was linked to UltraLink NeutrAvidin™ resin as previously described (40 pmol) which was washed twice with elution buffer. The eluent from the first column purification was then run on the second column. The use of this column allowed for binding of RNA that non-specifically diluted from the first column, while RNA that performed a catalytic event and had product bound to it, flowed through the second column. The fractions were ethanol precipitated using glycogen as carrier and rehydrated in sterile water for amplification.

Amplification

RNA and primer MST3 (10–100 pmol) were denatured at 90° C. for 3 minutes in water and then snap-cooled on ice for one minute. The following reagents were added to the tube (final concentrations given): 1×PCR buffer (Boerhinger Mannheim), 1 mM dNTP's (for PCR, Boerhinger Mannheim), 2 U/µl RNase-Inhibitor (Boerhinger Mannheim), 10 U/µl Superscript™ II Reverse Transcriptase (BRL). The reaction was incubated for 1 hour at 42° C., then at 95° C. for 5 minutes in order to destroy the Superscript™. The following reagents were then added to the tube to increase the volume five-fold for the PCR step (final concentrations/amounts given): MST7c primer (10–100 pmol, same amount as in RT step), 1×PCR buffer, taq DNA polymerase (0.025–0.05 U/µl, Boerhinger Mannheim). The reaction was cycled as follows: 94° C., 4 minutes; (94° C., 30s; 42–54° C., 30s; 72° C., 1 minute)×4–30 cycles; 72° C., 5 minutes; 30° C., 30 minutes. Cycle number and annealing temperature were decided on a round by round basis. In cases where heteroduplex was observed, the reaction was diluted five-fold with fresh reagents and allowed to progress through 2 more amplification cycles. Resulting products were analyzed for size on an agarose gel (N60=123 bp, N40=103 bp, N20=83 bp) and then ethanol precipitated.

Transcriptions

Transcription of amplified products was done using the conditions described above with the following modifications: 10–20% of the amplification reaction was used as template, reaction volume was 100–500 µl, and the products sizes varied slightly (N60=106 ntds, N40=86, N20=66). A small amount of $^{32}$P-GTP was added to the reactions for quantitation purposes.

Subsequent Rounds

Subsequent rounds of selection used 20 pmols of input RNA and 40 pmol of the 22 nucleotide substrate on the column.

Activity of Pools

Pools were assayed for activity under single turnover conditions every three to four rounds. Activity assay conditions were as follows: 50 mM tris-HCl (pH 8.5), 25 mM MgCl$_2$, 100 mM NaCl, 50 mM KCl, trace $^{32}$P-labeled substrate, 10 nM RNA pool. 2×pool in buffer and, separately, 2×substrate in buffer were incubated at 90° C. for 3 minutes, then at 37° C. for 3 minutes. Equal volume 2×substrate was then added the 2×pool tube (t=0). Initial assay time points were taken at 4 and 24 hours: 5 µl was removed and quenched in 8 µl cold Stop buffer (96% formamide, 20 mM EDTA, 0.05% bromphenyl blue/xylene cyanol). Samples were heated 90° C., 3 minutes, and loaded on a 20% sequencing gel. Quantitation was performed using a Molecular Dynamics Phosphorimager and ImageQuaNT™ software. The data is shown in Table IX.

Samples from the pools of oligonucleotide were cloned into vectors and sequenced using standard protocols (Sambrook et al., *Molecular Cloning: A Laboratory Manual*, Cold Spring Harbor Laboratory Press). The enzymatic nucleic acid molecules were transcribed from a representative number of these clones using methods described in this application. Individuals from each pool were tested for RNA cleavage from N60 and N40 by incubating the enzymatic nucleic acid molecules from the clones with 5/16 substrate in 2 mM MgCl2, pH 7.5, 10 mM KCl at 37° C. The data in Table XI shows that the enzymatic nucleic acid molecules isolated from the pool are individually active.

Kinetic Activity

Kinetic activity of the enzymatic nucleic acid molecule shown in Table XI, was determined by incubating enzymatic nucleic acid molecule (10 nM) with substrate in a cleavage buffer (pH 8.5, 25 mM MgCl$_2$, 100 mM NaCl, 50 mM KCl) at 37° C.

Magnesium Dependence

Magnesium dependence of round 15 of N20 was tested by varying MgCl$_2$ while other conditions were held constant (50 mM tris [pH 8.0], 100 mM NaCl, 50 mM KCl, single turnover, 10 nM pool). The data is shown in Table XII, which demonstrates increased activity with increased magnesium concentrations.

Example 9

Selection of Novel Enzymatic Nucleic Acid Molecule Motifs Using 2'-Deoxy-2'-(N-histidyl) amino UTP, 2'-Fluoro-ATP, and 2'-deoxy-2'-amino CTP and GTP The method described in example 8 was repeated using 2'-Deoxy-2'-(N-histidyl)amino UTP, 2'-Fluoro-ATP, and 2'-deoxy-2'-amino CTP and GTP. However, rather than causing cleavage on the initial column with $MgCl_2$, the initial random modified-RNA pool was loaded onto substrate-resin in the following buffer; 5 mM NaOAc pH 5.2, 1 M NaCl at 4° C. After ample washing, the resin was moved to 22° C. and the buffer switch 20 mM HEPES pH 7.4, 140 mM KCl, 10 mM NaCl, 1 mM $CaCl_2$, 1 mM $MgCl_2$. In one selection of N60 oligonucleotides, no divalent cations ($MgCl_2$, $CaCl_2$) was used. The resin was incubated for 10 minutes to allow reaction and the eluant collected.

The enzymatic nucleic acid molecule pools were capable of cleaving 1–3% of the present substrate even in the absense of divalent cations, the background (in the absence of modified pools) was 0.2–0.4%.

Example 10

Synthesis of 5-substituted 2'-modified Nucleosides

When designing monomeric nucleoside triphosphates for selection of therapeutic catalytic RNAs, one has to take into account nuclease stability of such molecules in biological sera. A common approach to increase RNA stability is to replace the sugar 2'-OH group with other groups like 2'-fluoro, 2'-O-methyl or 2'-amino. Fortunately such 2'-modified pyrimidine 5'triphosphates are shown to be substrates for RNA polymerases.[5,7] On the other hand it was shown that variety of substituents at pyrimidine 5-position is well tolerated by T7 RNA polymerase,[1] most likely because the natural hydrogen-bonding pattern of these nucleotides is preserved. We have chosen 2'-fluoro and 2'-O-methyl pyrimidine nucleosides as starting materials for attachment of different functionalities to the 5-position of the base. Both rigid (alkynyl) and flexible (alkyl) spacers are used. The choice of imidazole, amino and carboxylate pendant groups is based on their ability to act as general acids, general bases, nucleophiles and metal ligands, all of which can improve the catalytic effectiveness of selected nucleic acids. FIGS. 12–15 relate to the synthesis of these compounds.

2'-O-methyluridine was 3',5'-bis-acetylated using acetic anhydride in pyridine and then converted to its 5-iodo derivative 1a using $I_2$/ceric ammonium nitrate reagent[8] (Scheme 1). Both reactions proceeded in a quantitative yield and no chromatographic purifications were needed. Coupling between 1 and N-trifluoroacetyl propargylamine using copper(I) iodide and tetrakis(triphenylphosphine)palladium (0) catalyst as described by Hobbs[9] yielded 2a in 89% yield. Selective O-deacylation with aqueous NaOH afforded 3a which was phosphorylated with $POCl_3$/triethylphosphate (TEP) in the presence of 1,8-bis(dimethylamino) naphthalene (Proton-Sponge) (Method A).[10] The intermediate nucleoside phosphorodichloridate was condensed in situ with tri-n-butylammonium pyrophosphate. At the end, the N-TFA group was removed with concentrated ammonia. 5'-Triphosphate was purified on Sephadex DEAE A-25 ion exchange column using a linear gradient of 0.1–0.8M triethylammonium bicarbonate (TEAB) for elution. Traces of contaminating inorganic pyrophosphate are removed using C-18 RP HPLC to afford analytically pure material. Conversion into Na-salt was achieved by passing the aqueous solution of triphosphate through Dowex 50WX8 ion exchange resin in $Na^+$ form to afford 4a in 45% yield. When Proton-Sponge was omitted in the first phosphorylation step, yields were reduced to 10–20%. Catalytic hydrogenation of 3a yielded 5-aminopropyl derivative 5a which was phosphorylated under conditions identical to those described for propynyl derivative 3a to afford triphosphate 6a in 50% yield.

For the preparation of imidazole derivatized triphosphates 9a and 11a, we developed an efficient synthesis of N-diphenylcarbamoyl 4-imidazoleacetic acid ($ImAA^{DPC}$): Transient protection of carboxyl group as TMS-ester using TMS-Cl/pyridine followed by DPC-Cl allowed for a clean and quantitative conversion of 4-imidazoleacetic acid (ImAA) to its N-DPC protected derivative.

Complete deacylation of 2a afforded 5-(3-aminopropynyl) derivative 8a which was condensed with 4-imidazoleacetic acid in the presence of 1-(3-dimethylaminopropyl)-3-ethylcarbodiimide (EDC) to afford 9a in 68% yield. Catalytic hydrogenation of 8a yielded 5-(3-aminopropyl) derivative 10a which was condensed with $ImAA^{DPC}$ to yield conjugate 11a in 32% yield. Yields in these couplings were greatly improved when 5'-OH was protected with DMT group (not shown) thus efficiently preventing undesired 5'-O-esterification. Both 9a and 11a failed to yield triphosphate products in reaction with $POCl_3$/TEP/Proton-Sponge.

On the contrary, phosphorylation of 3'-O-acetylated derivatives 12a and 13a using 2-chloro-4H-1,3,2-benzodioxaphosphorin-4-one followed by pyrophosphate addition and oxidation (Method B,[11] Scheme 2) afforded the desired triphosphates 14a and 15a in 57% yield, respectively.

2'-Deoxy-2'-fluoro nucleoside 5'-triphosphates containing amino-(4b, 6b) and imidazole-(14b,15b) linked groups were synthesized in a manner analogous to that described for the preparation of 2'-O-methyl nucleoside 5'-triphosphates (Schemes 1 and 2). Again, only Ludwig-Eckstein's phosphorylation worked for the preparation of 4-imidazoleacetyl derivatized triphosphates.

It is worth noting that when "one-pot-two-steps" phosphorylation reaction[10] of 5b was quenched with 40% aqueous methylamine instead of TEAB or $H_2O$, the -amidate 7b was generated as the only detectable product. Similar reaction was reported recently for the preparation of the γ-amidate of pppA2'p5'A2'p5'A.[12]

Carboxylate group was introduced into 5-position of uridine both on the nucleoside level and post-synthetically (Method C) (Scheme 3). 5-Iodo-2'-deoxy-2'-fluorouridine (16) was coupled with methyl acrylate using modified Heck reaction[13] to yield 17 in 85% yield. 5'-O-Dimethoxytritylation, followed by in situ 3'-O-acetylation and subsequent detritylation afforded 3'-protected derivative 18. Phosphorylation using 2-chloro-4H-1,3,2-benzodioxaphosphorin-4-one followed by pyrophosphate addition and oxidation[11] afforded the desired triphosphate in 54% yield. On the other hand, 5-(3-aminopropyl)uridine 5'-triphosphate 6b was coupled with N-hydroxysuccinimide ester of Fmoc-Asp-OFm to afford, after removal of Fmoc and Fm groups with diethylamine, the desired aminoacyl conjugate 20 in 50% yield.

Cytidine derivatives comprising 3-aminopropyl and 3(N-succinyl)aminopropyl groups were synthesized according to Scheme 4. Peracylated 5-(3-aminopropynyl)uracil derivative 2b is reduced using catalytic hydrogenation and then converted in seven steps and 5% overall yield into 3'-acetylated cytidine derivative 25. This synthesis was plagued by poor solubility of intermediates and formation of the $N^4$-cyclized byproduct during ammonia treatment of the 4-triazolyl intermediate. Phosphorylation of 25 as described in reference 11 yielded triphosphate 26 and $N^4$-cyclized product 27 in 1:1 ratio. They were easily separated on Sephadex DEAE A-25 ion exchange column using 0.1–0.8M TEAB gradient. It appears that under basic conditions the free primary amine can displace any remaining intact 4-NHBz group leading to the cyclized product. This is similar to displacement of 4-triazolyl group by primary amine as mentioned above.

We reasoned that utilization of $N^4$-unprotected cytidine will solve this problem. This lead to an improved synthesis of 26: Iodination of 2'-deoxy-2'-fluorocytidine (28) provided the 5-iodo derivative 29 in 58% yield. This compound was then smoothly converted into 5-(3-aminopropynyl) derivative 30. Hydrogenation afforded 5-(3-aminopropyl) derivative 31 which was phosphorylated directly with $POCl_3$/PPi to afford 26 in 37% yield. Coupling of the 5'-triphosphate 26 with succinic anhydride yielded succinylated derivative 32 in 36% yield.

REFERENCES

1. Tarasow, T. M.; Eaton, B. E. Biopolymers 1998, 48, 29.
2. Eaton, B. E.; Pieken, W. A. Annu. Rev. Biochem. 1995, 64, 837.
3. Eaton, B. E. Curr. Opin. Chem. Biol. 1997, 1, 10.
4. Dewey, T. M.; Mundt, A. A.; Crouch, G. J.; Zyzniewski, M. C., Eaton, B. E. J. Am. Chem. Soc. 1995, 32, 8475.
5. Aurup, H.; Williams, D. M.; Eckstein, F. Biochemistry 1992, 31, 9637.
6. Sakthivel, K.; Barbas III, C. F. Angew. Chem. Int. Ed. 1998, 37, 2872.
7. Padilla, R.; Sousa, R. Nucleic Acids Res. 1999, 27, 1561.
8. Asakura, J.; Robins, M. J. J. Org. Chem. 1990, 55, 4928.
9. Hobbs, F. W.,Jr. J. Org. Chem. 1989, 54, 3420.
10. Kovácz, T; Ötvös, L. Tetrahedron Lett. 1988, 29, 4525.
11. Ludwig, J.; Eckstein, F. J. Org. Chem. 1989, 54, 631.
12. Nyilas, A. Tetrahedron Lett. 1997, 38, 2517.
13. Dyer, R. L.; Jones, A. S.; Walker, R. T. in Nucleic Acid Chemistry; Townsend, L. B. and Tipson, R. T., Ed.; John Wiley & Sons, Inc., New, York, 1991; p. 79.

Example 11

Synthesis of 5-Imidazoleacetic Acid 2'-deoxy-5'-triphosphate Uridine 5-dintrophenylimidazoleacetic acid 2'-deoxy uridine nucleoside (80 mg) was dissolved in 5 ml of triethylphosphate while stirring under argon, and the reaction mixture was cooled to 0° C. Phosphorous oxychloride (1.8 eq, 22 ml) was added to the reaction mixture at 0° C. three more aliquots were added over the course of 48 hours at room temperature. The reaction mixture was then diluted with anhydrous MeCN (5 ml) and cooled to 0° C., followed by the addition of tributylamine (0.65 ml) and tributylammonium pyrophosphate (4.0 eq, 0.24 g). After 45 minutes, the reaction was quenched with 10 ml aq. methyl amine for four hours. After co-evaporation with MeOH (3x), purified material on DEAE Sephadex followed by RP chromatography to afford 15 mg of triphosphate.

Example 12

Synthesis of 2'-(N-lysyl)-amino-2'-deoxy-cytidine Triphosphate

2'-(N-lysyl)-amino-2'-deoxy cytidine (0.180 g, 0.22 mmol) was dissolved in triethyl phosphate (2.00 ml) under Ar. The solution was cooled to 0° C. in an ice bath. Phosphorus oxychloride (99.999%, 3 eq., 0.0672 mL) was added to the solution and the reaction was stirred for two hours at 0° C. Tributylammonium pyrophosphate (4 eq., 0.400 g) was dissolved in 3.42 mL of acetonitrile and tribuytylamine (0.165 mL). Acetonitrile (1 mL) was added to the monophosphate solution followed by the pyrophosphate solution which was added dropwise. The resulting solution was clear. The reaction was allowed to warm up to room temperature. After stirring for 45 minutes, methylamine (5 mL) was added and the reaction and stirred at room temperature for 2 hours. A biphasic mixture appeared (little beads at the bottom of the flask). TLC (7:1:2 iPrOH:$NH_4OH$:$H_2O$) showed the appearance of triphosphate material. The solution was concentrated, dissolved in water and loaded on a newly prepared DEAE Sephadex A-25 column. The column was washed with a gradient up to 0.6 M TEAB buffer and the product eluted off in fractions 90–95. The fractions were analyzed by ion exchange HPLC. Each fraction showed one triphosphate peak that eluted at ~4.000 minutes. The fractions were combined and pumped down from methanol to remove buffer salt to yield 15.7 mg of product.

Example 13

Synthesis of 2'-deoxy-2'-(L-histidine)amino Cytidine Triphosphate

2'-[N-Fmoc, $N^{imid}$-dinitrophenyl-histidyl]amino-2'-cytidine (0.310 g, 4.04 mmol) was dissolved in triethyl phosphate (3 ml) under Ar. The solution was cooled to 0° C. Phosphorus oxychloride (1.8 eq., 0.068 mL) was added to the solution and stored overnight in the freezer. The next morning TLC (10% MeOH in $CH_2Cl_2$) showed significant starting material, one more equivalent of $POCl_3$ was added. After two hours, TLC still showed starting material. Tributylamine (0.303 mL) and Tributylammonium pyrophosphate (4 eq., 0.734 g) dissolved in 6.3 mL of acetonitrile (added dropwise) were added to the monophosphate solution. The reaction was allowed to warm up to room temperature. After stirring for 15 min, methylamine (10 mL) was added at room temperature and stirring continued for 2 hours. TLC (7:1:2 iPrOH:$NH_4OH$:$H_2O$) showed the appearance of triphosphate material. The solution was concentrated, dissolved in water and loaded on a DEAE Sephadex A-25 column. The column was washed with a gradient up to 0.6 M TEAB buffer and the product eluted off in fractions 170–179. The fractions were analyzed by ion exchange HPLC. Each fraction showed one triphosphate peak that eluted at ~6.77 minutes. The fractions were combined and pumped down from methanol to remove buffer salt to afford 17 mg of product.

Example 14

Screening for Novel Enzymatic Nucleic Acid Molecule Motifs Using Modified NTPs (Class I Motif)

Our initial pool contained 3x10$^{14}$ individual sequences of 2'-amino-dCTP/2'-amino-duTP RNA. We optimized transcription conditions in order to increase the amount of RNA product by inclusion of methanol and lithium chloride. 2'-amino-2'-deoxynucleotides do not interfere with the reverse transcription and amplification steps of selection and confer nuclease resistance. We designed the pool to have two binding arms complementary to the substrate, separated by the random 40 nucleotide region. The 16-mer substrate had two domains, 5 and 10 nucleotides long, that bind the pool, separated by an unpaired guanosine. On the 5' end of the substrate was a biotin attached by a C18 linker. This enabled us to link the substrate to a NeutrAvidin resin in a column format. The desired reaction would be cleavage at the unpaired G upon addition of magnesium cofactor followed by dissociation from the column due to instability of the 5 base pair helix. A detailed protocol follows:

Enzymatic nucleic acid molecule Pool Prep: The initial pool DNA was prepared by converting the following template oligonucleotides into double-standed DNA by filling in with taq polymerase. (template=5'-ACC CTC ACT AAA GGC CGT (N)$_{40}$ GGT TGC ACA CCT TTC-3', (SEQ ID NO: 1520); primer 1=5'-CAC TTA GCA TTA ACC CTC ACT AAA GGC CGT-3', (SEQ ID NO: 1521); primer 2=5'-TAA TAC GAC TCA CTA TAG GAA AGG TGT GCA ACC-3', (SEQ ID NO: 1522)). All DNA oligonucleotides were synthesized by Operon technologies. Template oligos were purified by denaturing PAGE and Sep-pak chromatography columns (Waters). RNA substrate oligos were synthesized using standard solid phase chemistry and purified by denaturing PAGE followed by ethanol precipitation. Substrates for in vitro cleavage assays were 5'-end labeled with gamma-$^{32}$P-ATP and T4 polynucleotide kinase followed by denaturing PAGE purification and ethanol precipitation.

5 nmole of template, 10 nmole of each primer and 250 U taq polymerase were incubated in a 10 ml volume with 1×PCR buffer (10 mM tris-HCl (pH 8.3), 1.5 mM MgCl$_2$, 50 mM KCl) and 0.2 mM each dNTP as follows: 94° C. 4 minutes; (94° C., 1 min; 42° C., 1 min; 72° C., 2 min) through four cycles; and then 72° C., for 10 minutes. The product was analyzed on 2% Separide™ agarose gel for size and then was extracted twice with buffered phenol, then chloroform-isoamyl alcohol, and ethanol precipitated. The initial RNA pool was made by transcription of 500 pmole (3×10$^{14}$ molecules) of this DNA as follows. Template DNA was added to 40 mM tris-HCl (pH 8.0), 12 mM MgCl$_2$, 5 mM dithiothreitol (DTT), 1 mM spermidine, 0.002% triton X-100, 1 mM LiCl, 4% PEG-8000, 10% methanol, 2 mM ATP, 2 mM GTP, 2 mM 2'-amino-dCTP, 2 mM 2'-amino-dUTP, 5 U/ml inorganic pyrophosphatase, and 5 U/μl T7 RNA polymerase at room temperature for a total volume of 1 ml. A separate reaction contained a trace amount of alpha-$^{32}$P-GTP for detection. Transcriptions were incubated at 37° C. for 2 hours followed by addition of equal volume STOP buffer (94% formamide, 20 mM EDTA, 0.05% bromophenol blue). The resulting RNA was purified by 6% denaturing PAGE gel, Sep-pak™ chromatography, and ethanol precipitated.

INITIAL SELECTION: 2 nmole of 16 mer 5'-biotinylated substrate (5'-biotin-C18 linker-GCC GUG GGU UGC ACA C-3' (SEQ ID NO: 1494)) was linked to 200 μl UltraLink Immobilized NeutrAvidin™ resin (400 μl slurry, Pierce) in binding buffer (20 mM NaPO$_4$ (pH 7.5), 150 mM NaCl) for 30 minutes at room temperature. The resulting substrate column was washed with 2 ml binding buffer followed by 2 ml column buffer (50 mM tris-HCl (pH 8.5), 100 mM NaCl, 50 mM KCl). The flow was capped off and 1000 pmole of initial pool RNA in 200 μl column buffer was added to the column and incubated 30 minutes at room temperature. The column was uncapped and washed with 2 ml column buffer, the capped off. 200 μl elution buffer (=column buffer+25 mM MgCl$_2$) was added to the column and allowed to incubate 30 minutes at room temperature. The column was uncapped and eluent collected followed by three 200 μl elution buffer washes. The eluent/washes were ethanol precipitated using glycogen as carrier and rehydrated in 50 μl sterile H$_2$O. The eluted TNA was amplified by standard reverse transcription/PCR amplification techniques. 5–31 μl RNA was incubated with 20 pmol of primer 1 in 14 μl volume at 90° C. for 3 min then placed on ice for 1 minute. The following reagents were added (final concentrations noted): 1×PCR buffer, 1 mM each dNTP, 2 U/μl RNase Inhibitor, 10 U/μl SuperScript™ II reverse transcriptase. The reaction was incubated 42° C. for 1 hour followed by 95° C. for 5 min in order to inactivate the reverse transcriptase. The volume was then increased to 100 μl by adding water and reagents for PCR: 1×PCR buffer, 20 pmol primer 2, and 2.5 U taq DNA polymerase. The reaction was cycled in a Hybaid thermocycler: 94° C., 4 min; (94° C., 30 sec; 54° C., 30 sec; 72° C., 1 min)×25; 72° C., 5 min. Products were analyzed on agarose gel for size and ethanol precipitated. One-third to one-fifth of the PCR DNA was used to transcribe the next generation, in 100 μl volume, as described above. Subsequent rounds used 20 pmol RNA for the column with 40 pmol substrate.

TWO COLUMN SELECTION: At generation 8 (G8), the column selection was changed to the two column format. 200 pmoles of 22 mer 5'-biotinylated substrate (5'-biotin-C18 linker-GCC GUG GGU UGC ACA CCU UUC C-C18 linker-thiol modifier C6 S-S-inverted abasic-3'; (SEQ ID NO: 1515)) was used in the selection column as described above. Elution was in 200 μL elution buffer followed by a 1 ml elution buffer wash. The 1200 μl eluent was passed through a product trap column by gravity. The product trap column was prepared as follows: 200 pmol 16 mer 5'-biotinylated "product" (5'-GGU UGC ACA CCU UCC C-C18 linker biotin-3'; (SEQ ID NO: 1516)) was linked to the column as described above and the column was equilibrated in elution buffer. Eluent from the product column was precipitated as previously described. The products were amplified as above only with 2.5-fold more volume and 100 pmol each primer. 100 μl of the PCR reaction was used to do a cycle course; the remaining fraction was amplified the minimal number of cycles needed for product. After 3 rounds (G11), there was visible activity in a single runover cleavage assay. By generation 13, 45% of the substrate was cleaved at 4 hours; k$_{obs}$ of the pool was 0.037 min-1 in 25 mM MgCl$_2$. We subcloned and sequenced generation 13; the pool was still very diverse. Since our goal was an enzymatic nucleic acid molecule that would work in a physiological environment, we decided to change selection pressure rather than exhaustively catalog G13.

Reselection of the N40 pool was started from G12 DNA. Part of the G12 DNA was subjected to hypermutagenic PCR (Vartanian et al., 1996, *Nucleic Acids Research* 24, 2627–2631) to introduce a 10% per position mutation frequency and was designated N40H. At round 19, part of the DNA was hypermutagenized again, giving N40M and N40HM (a total of 4 parallel pools). The column substrates remained the same; buffers were changed and temperature of binding and elution was raised to 37° C. Column buffer was replaced by physiological buffer (50 mM tris-HCl (pH 7.5), 140 mM KCl, 10 mM NaCl) and elution buffer was replaced by 1 mM Mg buffer (physiological buffer+1 mM MgCl$_2$). Amount of time allowed for the pool to bind the column was eventually reduced to 10 min and elution time was gradually reduced from 30 min to 20 sec. Between rounds 18 and 23, k$_{obs}$ for the N40 pool stayed relatively constant at 0.035–0.04 min$^{-1}$. Generation 22 from each of the 4 pools was cloned and sequenced.

CLONING AND SEQUENCING: Generations 13 and 22 were cloned using Novagen's Perfectly Blunt™ Cloning kit (pT7Blue-3 vector) following the kit protocol. Clones were screened for insert by PCR amplification using vector-specific primers. Positive clones were sequenced using ABI Prism 7700 sequence detection system and vector-specific primer. Sequences were aligned using MacVector software; two-dimensional folding was performed using Mulfold software (Zuker, 1989, *Science* 244, 48–52; Jaeger et al., 1989, *Biochemistry* 86, 7706–7710; Jaeger et al., 1989, R. F. Doolittle ed., *Methods in Enzymology*, 183, 281–306). Individual clone transcription units were constructed by PCR amplification with 50 pmol each primer 1 and primer 2 in 1×PCR buffer, 0.2 mM each dNTP, and 2.5 U of taq polymerase in 100 µl volume cycled as follows: 94° C., 4 min; (94° C., 30 sec; 54° C., 30 sec; 72° C., 1 min)×20; 72° C., 5 min. Transcription units were ethanol precipitated, rehydrated in 30 µl H2O, and 10 µl was transcribed in 100 µl volume and purified as previously described.

Thirty-six clones from each pool were sequenced and were found to be variations of the same consensus motif. Unique clones were assayed for activity in 1 mM $MgCl_2$ and physiological conditions; nine clones represented the consensus sequence and were used in subsequent experiments. There were no mutations that significantly increased activity; most of the mutations were in regions believed to be duplex, based on the proposed secondary structure. In order to make the motif shorter, we deleted the 3'-terminal 25 nucleotides necessary to bind the primer for amplification. The measured rates of the full length and truncated molecules were both 0.04 $min^{-1}$; thus we were able reduce the size of the motif from 86 to 61 nucleotides. The molecule was shortened even further by truncating base pairs in the stem loop structures as well as the substrate recognition arms to yield a 48 nucleotide molecule. In addition, many of the ribonucleotides were replaced with 2-O-methyl modified nucleotides to stabilize the molecule. An example of the new motif is given in FIG. 4. Those of ordinary skill in the art will recognize that the molecule is not limited to the chemical modifications shown in the figure and that it represents only one possible chemically modified molecule.

KINETIC ANALYSIS

Single turnover kinetics were performed with trace amounts of 5'-$^{32}$P-labeled substrate and 10–1000 nM pool of enzymatic nucleic acid molecule. 2×substrate in 1×buffer and 2×pool/enzymatic nucleic acid molecule in 1×buffer were incubated separately 90° for 3 min followed by equilibration to 37° for 3 min. Equal volume of 2×substrate was added to pool/enzymatic nucleic acid molecule at to and the reaction was incubated at 37° C. Time points were quenched in 1.2 vol STOP buffer on ice. Samples were heated to 90° C. for 3 min prior to separation on 15% sequencing gels. Gels were imaged using a PhosphorImager and quantitated using ImageQuant™ software (Molecular Dynamics). Curves were fit to double-exponential decay in most cases, although some of the curves required linear fits.

STABILITY: Serum stability assays were performed as previously described (Beigelman et al., 1995, *J. Biol. Chem.* 270, 25702–25708). 1 µg of 5'-$^{32}$P-labeled synthetic enzymatic nucleic acid molecule was added to 13 µl cold and assayed for decay in human serum. Gels and quantitation were as described in kinetics section.

SUBSTRATE REQUIREMENTS: Table XVII outlines the substrate requirements for Class I motif. Substrates maintained Watson-Crick or wobble base pairing with mutant Class I constructs. Activity in single turnover kinetic assay is shown relative to wild type Class I and 22 mer substrate (50 mM Tris-HCL (pH 7.5), 140 mM KCl, 10 mM NaCl, 1 mM $MgCl_2$, 100 nM ribozyme, 5 nM substrate, 37° C.).

RANDOM REGION MUTATION ALIGNMENT: Table XVII outlines the random region alignment of 134 clones from generation 22 (1.x=N40, 2.x=N40M, 3.x=N40H, 4.x= N40HM). The number of copies of each mutant is in parenthesis in the table, deviations from consensus are shown. Mutations that maintain base pair U19:A34 are shown in italic. Activity in single turnover kinetic assay is shown relative to the G22 pool rate (50 mM Tris-HCL pH 7.5, 140 mM KCl, 10 mM NaCl, 1 mM $MgCl_2$, 100 nM ribozyme, trace substrate, 37° C.).

STEM TRUNCATION AND LOOP REPLACEMENT ANALYSIS: FIG. 16 shows a representation of Class I ribozyme stem truncation and loop replacement analysis. The $K_{rel}$ is compared to a 61 mer Class I ribozyme measured as described above. FIG. 17 shows examples of Class I ribozymes with truncated stem(s) and/or non-nucleotide linker replaced loop structures.

Example 15

Inhibition of HCV Using Class I (Amberzyme) Motif

During HCV infection, viral RNA is present as a potential target for enzymatic nucleic acid molecule cleavage at several processes: uncoating, translation, RNA replication and packaging. Target RNA may be more or less accessible to enzymatic nucleic acid molecule cleavage at any one of these steps. Although the association between the HCV initial ribosome entry site (IRES) and the translation apparatus is mimicked in the HCV 5'UTR/luciferase reporter system (example 9), these other viral processes are not represented in the OST7 system. The resulting RNA/protein complexes associated with the target viral RNA are also absent. Moreover, these processes may be coupled in an HCV-infected cell which could further impact target RNA accessibility. Therefore, we tested whether enzymatic nucleic acid molecules designed to cleave the HCV 5'UTR could effect a replicating viral system.

Recently, Lu and Wimmer characterized an HCV-poliovirus chimera in which the poliovirus IRES was replaced by the IRES from HCV (Lu & Wimmer, 1996, *Proc. Natl. Acad. Sci. USA.* 93, 1412–1417). Poliovirus (PV) is a positive strand RNA virus like HCV, but unlike HCV is non-enveloped and replicates efficiently in cell culture. The HCV-PV chimera expresses a stable, small plaque phenotype relative to wild type PV.

The capability of the new enzymatic nucleic acid molecule motifs to inhibit HCV RNA intracellularly was tested using a dual reporter system that utilizes both firefly and Renilla luciferase (FIG. 5). A number of enzymatic nucleic acid molecules having the new class I motif (Amberzyme) were designed and tested (Table XIII). The Amberzyme ribozymes were targeted to the 5' HCV UTR region, which when cleaved, would prevent the translation of the transcript into luciferase. OST-7 cells were plated at 12,500 cells per well in black walled 96-well plates (Packard) in medium DMEM containing 10% fetal bovine serum, 1% pen/strep, and 1% L-glutamine and incubated at 37° C. overnight. A plasmid containing T7 promoter expressing 5' HCV UTR and firefly luciferase (T7C1-341 (Wang et al., 1993, *J. of Virol.* 67, 3338–3344)) was mixed with a pRLSV40 Renilla control plasmid (Promega Corporation) followed by enzymatic nucleic acid molecule, and cationic lipid to make a 5×concentration of the reagents (T7C1-341 (4 µg/ml), pRLSV40 renilla luciferase control (6 µg/ml), enzymatic nucleic acid molecule (250 nM), transfection reagent (28.5 µg/ml).

The complex mixture was incubated at 37° C. for 20 minutes. The media was removed from the cells and 120 µl of Opti-mem media was added to the well followed by 30 μl of the 5×complex mixture. 150 μl of Opti-mem was added to the wells holding the untreated cells. The complex mixture was incubated on OST-7 cells for 4 hours, lysed with passive lysis buffer (Promega Corporation) and luminescent signals were quantified using the Dual Luciferase Assay Kit using the manufacturer's protocol (Promega Corporation). The data shown in FIG. 6 is a dose curve of enzymatic nucleic acid molecule targeting site 146 of the HCV RNA and is presented as a ratio between the firefly and Renilla luciferase fluorescence. The enzymatic nucleic acid molecule was able to reduce the quantity of HCV RNA at all enzymatic nucleic acid molecule concentrations yielding an IC 50 of approximately 5 nM. Other sites were also efficacious (FIG. 7), in particular enzymatic nucleic acid molecules targeting sites 133, 209, and 273 were also able to reduce HCV RNA compared to the irrelevant (IRR) controls.

Example 16

Cleavage of Substrates Using Completely Modified Class I (Amberzyme) Enzymatic Nucleic Acid Molecule The ability of an enzymatic nucleic acid, which is modified at every 2' position to cleave a target RNA was tested to determine if any ribonucleotide positions are necessary in the Amberzyme motif Enzymatic nucleic acid molecules were constructed with 2'-O-methyl, and 2'-amino (NH2) nucleotides and included no ribonucleotides (Table XIII; gene name: no ribo) and kinetic analysis was performed as described in example 13. 100 nM enzymatic nucleic acid was mixed with trace amounts of substrate in the presence of 1 mM $MgCl_2$ at physiological conditions (37° C.). The Amberzyme with no ribonucleotide present in it has a $K_{rel}$ of 0.13 compared to the enzymatic nucleic acid with a few ribonucleotides present in the molecule shown in Table XIII (ribo). This shows that Amberzyme enzymatic nucleic acid molecule may not require the presence of 2'-OH groups within the molecule for activity.

Example 17

Substrate Recognition Rules for Class II (zinzyme) Enzymatic Nucleic Acid Molecules Class II (zinzyme) ribozymes were tested for their ability to cleave base-paired substrates with all sixteen possible combinations of bases immediately 5' and 3' proximal to the bulged cleavage site G. Ribozymes were identical in all remaining positions of their 7 base pair binding arms. Activity was assessed at two and twenty-four hour time points under standard reaction conditions [20 mM HEPES pH 7.4, 140 mM KCl, 10 mM NaCl, 1 mM $MgCl_2$, 1 mM $CaCl_2$ —37° C.]. FIG. 10 shows the results of this study. Base paired substrate UGG (not shown in the figure) cleaved as poorly as CGG shown in the figure. The figure shows the cleavage site substrate triplet in the 5'-3' direction and 2 and 24 hour time points are shown top to bottom respectively. The results indicate the cleavage site triplet is most active with a 5'-Y-G-H-3' (where Y is C or U and H is A, C or U with cleavage between G and H); however activity is detected particularly with the 24 hour time point for most paired substrates. All positions outside of the cleavage triplet were found to tolerate any base pairings (data not shown).

All possible mispairs immediately 5' and 3' proximal to the bulged cleavage site G were tested to a class II ribozyme designed to cleave a 5'-C-G-C-3'. It was observed the 5' and 3' proximal sites are as active with G:U wobble pairs, in addition, the 5' proximal site will tolerate a mismatch with only a slight reduction in activity [data not shown].

Example 18

Screening for Novel Enzymatic Nucleic Acid Molecule Motifs (Class II Motifs)

The selections were initiated with pools of >$10^{14}$ modified RNA's of the following sequence: 5'-GGG AGG AGG AAG UGC CU $(N)_{35}$ UGC CGC GCU CGC UCC CAG UCC-3' (SEQ ID NO: 1517). The RNA was enzymatically generated using the mutant T7 Y639F RNA polymerase prepared by Rui Souza. The following modified NTP's were incorporated: 2'-deoxy-2'-fluoro-adenine triphophate, 2'-deoxy-2'-fluoro-uridine triphosphate or 2'-deoxy-2'-fluoro-5-[(N-imidazole-4-acetyl)propyl amine]uridine triphosphate, and 2'-deoxy-2'-amino-cytidine triphosphate; natural guanidine triphosphate was used in all selections so that alpha-$^{32}$P-GTP could be used to label pool TNA's. TNA pools were purified by denaturing gel electrophoresis, 8% polyacrylamide 7 M urea.

The following target RNA (resin A) was synthesized and coupled to Iodoacetyl Ultralink™ resin (Pierce) by the supplier's proceedure:5'-b-L-GGACUGGGAGCGAGCGCGG CGCAGGCACUGAAG-L-S-B-3'; where b is biotin (Glenn Research cat# 10-1953-nn), L is polyethylene glycol spacer (Glenn Research cat# 10-1918-nn), S is thiol-modifier C6 S-S (Glenn Research cat# 10-1936-nn), B is a standard inverted deoxy abasic.

RNA pools were added to 100 ul of 5 uM Resin A in the buffer A (20 mM HEPES pH 7.4, 140 mM KCL, 10 mM NaCl) and incubated at 22° C. for 5 minutes. The temperature was then raised to 37° C. for 10 minutes. The resin was washed with 5 ml buffer A. Reaction was triggered by the addition of buffer B(20 mM HEPES pH 7.4, 140 mM KCL, 10 mM NaCl, 1 mM $MgCl_2$, 1 mM $CaCl_2$). Incubation proceeded for 20 minutes in the first generation and was reduced progressively to 1 minute in the final generations; with 13 total generations. The reaction eluant was collected in 5 M NaCl to give a final concentration of 2 M NaCl. To this was added 100 μl of 50% slurry Ultralink NeutraAvidin™ (Pierce). Binding of cleaved biotin product to the avidin resin was allowed by 20 minute incubation at 22° C. The resin was subsequently washed with 5 ml of 20 mM HEPES pH 7.4, 2 M NaCl. Desired RNA's were removed by a 1.2 ml denaturing wash 1M NaCl, 10 M Urea at 94° C. over 10 minutes. RNA's were double precipitated in 0.3 M sodium acetate to remove Cl$^-$ ions inhibitory to reverse transcription. Standard protocols of reverse transcription and PCR amplification were performed. RNA's were again transcribed with the modified NTP's described above. After 13 generations cloning and sequencing provided 14 sequences which were able to cleave the target substrate. Six sequences were characterized to determine secondary structure and kinetic cleavage rates. The structures and kinetic data are given in FIG. 8. The sequences of eight other enzymatic nucleic acid molecule sequences are given in Table XIV. The size, sequence, and chemical compositions of these molecules can be modified as described under example 13 or using other techniques well known in the art. Nucleic Acid Catalyst Engineering Sequence, chemical and structural variants of Class I and Class II enzymatic nucleic acid molecule can be engineered and re-engineered using the techniques shown in this application and known in the art. For example, the size of class I and class II enzymatic nucleic acid molecules can, be reduced or increased using the techniques known in the art (Zaug et al., 1986, *Nature,* 324, 429; Ruffner et al., 1990, *Biochem.,* 29, 10695; Beaudry et al., 1990, *Biochem.,* 29, 6534; McCall et al., 1992, *Proc. Natl. Acad. Sci., USA.,* 89, 5710; Long et al., 1994, supra; Hendry et al., 1994, *BBA* 1219, 405; Benseler et al., 1993, *JACS,* 115, 8483; Thompson et al., 1996, *Nucl. Acids Res.,* 24, 4401; Michels et al., 1995, *Biochem.,* 34, 2965; Been et al., 1992, *Biochem.,* 31, 11843; Guo et al., 1995, *EMBO. J.,* 14, 368; Pan et al., 1994, *Biochem.,* 33, 9561; Cech, 1992, *Curr. Op. Struc. Bio.,* 2, 605; Sugiyama et al., 1996, *FEBS Lett.,* 392, 215; Beigelman et al., 1994, *Bioorg. Med. Chem.,* 4, 1715; Santoro et al., 1997, *PNAS* 94, 4262; all are incorporated in their totality by reference herein), to the extent that the overall catalytic activity of the ribozyrne is not significantly decreased.

Further rounds of in vitro selection strategies described herein and variations thereof can be readily used by a person skilled in the art to evolve additional nucleic acid catalysts and such new catalysts are within the scope of the instant invention.

Example 19

Activity of Class II (zinzyme) Nucleic Acid Catalysts to Inhibit HER2 Gene Expression HER2 (also known as neu, erbB2 and c-erbB2) is an oncogene that encodes a 185-kDa transmembrane tyrosine kinase receptor. HER2 is a member of the epidermal growth factor receptor (EGFR) family and shares partial homology with other family members. In normal adult tissues HER2 expression is low. However, HER2 is overexpressed in at least 25–30% of breast (McGuire & Greene, 1989) and ovarian cancers (Berchuck, et al., 1990). Furthermore, overexpression of HER2 in malignant breast tumors has been correlated with increased metastasis, chemoresistance and poor survival rates (Slamon et al., 1987 *Science* 235: 177–182). Because HER2 expression is high in aggressive human breast and ovarian cancers, but low in normal adult tissues, it is an attractive target for ribozyme-mediated therapy (Thompson et al., supra).

Cell Culture Review

The greatest HER2 specific effects have been observed in cancer cell lines that express high levels of HER2 protein (as measured by ELISA). Specifically, in one study that treated five human breast cancer cell lines with the HER2 antibody (anti-erbB2-sFv), the greatest inhibition of cell growth was seen in three cell lines (MDA-MB-361, SKBR-3 and BT-474) that express high levels of HER2 protein. No inhibition of cell growth was observed in two cell lines (MDA-MB-231 and MCF-7) that express low levels of HER2 protein (Wright et al., 1997). Another group successfully used SKBR-3 cells to show HER2 antisense oligonucleotide-mediated inhibition of HER2 protein expression and HER2 RNA knockdown (Vaughn et al., 1995). Other groups have also demonstrated a decrease in the levels of HER2 protein, HER2 mRNA and/or cell proliferation in cultured cells using anti-HER2 ribozymes or antisense molecules (Suzuki, T. et al., 1997; Weichen, et al., 1997; Czubayko, F. et al., 1997; Colomer, et al., 1994; Betram et al., 1994). Because cell lines that express higher levels of HER2 have been more sensitive to anti-HER2 agents, we prefer using several medium to high expressing cell lines, including SKBR-3 and T47D, for ribozyme screens in cell culture.

A variety of endpoints have been used in cell culture models to look at HER2-mediated effects after treatment with anti-HER2 agents. Phenotypic endpoints include inhibition of cell proliferation, apoptosis assays and reduction of HER2 protein expression. Because overexpression of HER2 is directly associated with increased proliferation of breast and ovarian tumor cells, a proliferation endpoint for cell culture assays will preferably be used as the primary screen. There are several methods by which this endpoint can be measured. Following treatment of cells with ribozymes, cells are allowed to grow (typically 5 days) after which either the cell viability, the incorporation of [$^3$H] thymidine into cellular DNA and/or the cell density can be measured. The assay of cell density is very straightforward and can be done in a 96-well format using commercially available fluorescent nucleic acid stains (such as Syto® 13 or CyQuant®). The assay using CyQuant® is described herein and is currently being employed to screen ~100 ribozymes targeting HER2 (details below).

As a secondary, confirmatory endpoint a ribozyme-mediated decrease in the level of HER2 protein expression can be evaluated using a HER2-specific ELISA.

Validation of Cell Lines and Ribozyme Treatment Conditions

Two human breast cancer cell lines (T47D and SKBR-3) that are known to express medium to high levels of HER2 protein, respectively, were considered for ribozyme screening. In order to validate these cell lines for HER2-mediated sensitivity, both cell lines were treated with the HER2 specific antibody, Herceptin® (Genentech) and its effect on cell proliferation was determined. Herceptin® was added to cells at concentrations ranging from 0–8 µM in medium containing either no serum (OptiMem), 0.1% or 0.5% FBS and efficacy was determined via cell proliferation. Maximal inhibition of proliferation (~50%) in both cell lines was observed after addition of Herceptin® at 0.5 nM in medium containing 0.1% or no FBS. The fact that both cell lines are sensitive to an anti-HER2 agent (Herceptin®) supports their use in experiments testing anti-HER2 ribozymes.

Prior to ribozyme screening, the choice of the optimal lipid(s) and conditions for ribozyme delivery was determined empirically for each cell line. Applicant has established a panel of cationic lipids (lipids as described in PCT application WO99/05094) that can be used to deliver ribozymes to cultured cells and are very useful for cell proliferation assays that are typically 3–5 days in length. (Additional description of useful lipids is provided above, and those skilled in the art are also familiar with a variety of lipids that can be used for delivery of oligonucleotide to cells in culture.) Initially, this panel of lipid delivery vehicles was screened in SKBR-3 and T47D cells using previously established control oligonucleotides. Specific lipids and conditions for optimal delivery were selected for each cell line based on these screens. These conditions were used to deliver HER2 specific ribozymes to cells for primary (inhibition of cell proliferation) and secondary (decrease in HER2 protein) efficacy endpoints.

Primary Screen: Inhibition of Cell Proliferation

Although optimal ribozyme delivery conditions were determined for two cell lines, the SKBR-3 cell line was used for the initial screen because it has the higher level of HER2 protein, and thus should be most susceptible to a HER2-specific ribozyme. Follow-up studies can be carried out in T47D cells to confirm delivery and activity results as necessary.

Ribozyme screens were be performed using an automated, high throughput 96-well cell proliferation assay. Cell proliferation was measured over a 5-day treatment period using the nucleic acid stain CyQuant® for determining cell density. The growth of cells treated with ribozyme/ lipid complexes were compared to both untreated cells and to cells treated with Scrambled-arm Attenuated core Controls (SAC; FIG. 11). SACs can no longer bind to the target site due to the scrambled arm sequence and have nucleotide changes in the core that greatly diminish ribozyme cleavage. These SACs are used to determine non-specific inhibition of cell growth caused by ribozyme chemistry (i.e. multiple 2' O-Me modified nucleotides, a single 2'C-allyl uridine, 4 phosphorothioates and a 3' inverted abasic). Lead ribozymes are chosen from the primary screen based on their ability to inhibit cell proliferation in a specific manner. Dose response assays are carried out on these leads and a subset was advanced into a secondary screen using the level of HER2 protein as an endpoint.

Secondary Screen: Decrease in HER2 Protein

A secondary screen that measures the effect of anti-HER2 ribozymes on HER2 protein levels is used to affirm preliminary findings. A robust HER2 ELISA for both T47D and SKBR-3 cells has been established and is available for use as an additional endpoint.

Ribozyme Mechanism Assays

A Taqman® assay for measuring the ribozyme-mediated decrease in HER2 RNA has also been established. This assay is based on PCR technology and can measure in real time the production of HER2 mRNA relative to a standard cellular mRNA such as GAPDH. This RNA assay is used to establish proof that lead ribozymes are working through an RNA cleavage mechanism and result in a decrease in the level of HER2 mRNA, thus leading to a decrease in cell surface HER2 protein receptors and a subsequent decrease in tumor cell proliferation.

Animal Models

Evaluating the efficacy of anti-HER2 agents in animal models is an important prerequisite to human clinical trials. As in cell culture models, the most HER2 sensitive mouse tumor xenografts are those derived from human breast carcinoma cells that express high levels of HER2 protein. In a recent study, nude mice bearing BT-474 xenografts were sensitive to the anti-HER2 humanized monoclonal antibody Herceptin®, resulting in an 80% inhibition of tumor growth at a 1 mg kg dose (ip, 2× week for 4–5 weeks). Tumor eradication was observed in 3 of 8 mice treated in this manner (Baselga et al., 1998). This same study compared the efficacy of Herceptin® alone or in combination with the commonly used chemotherapeutics, paclitaxel or doxorubicin. Although, all three anti-HER2 agents caused modest inhibition of tumor growth, the greatest antitumor activity was produced by the combination of Herceptin® and paclitaxel (93% inhibition of tumor growth vs 35% with paclitaxel alone). The above studies provide proof that inhibition of HER2 expression by anti-HER2 agents causes inhibition of tumor growth in animals. Lead anti-HER2 ribozymes chosen from in vitro assays are further tested in mouse xenograft models. Ribozymes are first tested alone and then in combination with standard chemotherapies.

Animal Model Development

Three human breast tumor cell lines (T47D, SKBR-3 and BT-474) were characterized to establish their growth curves in mice. These three cell lines have been implanted into the mammary papillae of both nude and SCID mice and primary tumor volumes are being measured 3 times per week. Growth characteristics of these tumor lines using a Matrigel implantation format can also be established. In addition, the use of two other breast cell lines that have been engineered to express high levels of HER2 can also be used. The tumor cell line(s) and implantation method that supports the most consistent and reliable tumor growth is used in animal studies testing the lead HER2 ribozyme(s). Ribozyme are administered by daily subcutaneous injection or by continuous subcutaneous infusion from Alzet mini osmotic pumps beginning 3 days after tumor implantation and continuing for the duration of the study. Group sizes of at least 10 animals are employed. Efficacy is determined by statistical comparison of tumor volume of ribozyme-treated animals to a control group of animals treated with saline alone. Because the growth of these tumors is generally slow (45–60 days), an initial endpoint will be the time in days it takes to establish an easily measurable primary tumor (i.e. 50–100 $mm^3$) in the presence or absence of ribozyme treatment.

CLINICAL SUMMARY

Overview

Breast cancer is a common cancer in women and also occurs in men to a lesser degree. The incidence of breast cancer in the United States is ~180,000 cases per year and ~46,000 die each year of the disease. In addition, 21,000 new cases of ovarian cancer per year lead to ~13,000 deaths (data from Hung et al., 1995 and the Surveillance, Epidemiology and End Results Program, NCI). Ovarian cancer is a potential secondary indication for anti-HER2 ribozyme therapy.

A full review of breast cancer is given in the NCI PDQ for Breast Cancer. A brief overview is given here. Breast cancer is evaluated or "staged" on the basis of tumor size, and whether it has spread to lymph nodes and/or other parts of the body. In Stage I breast cancer, the cancer is no larger than 2 centimeters and has not spread outside of the breast. In Stage II, the patient's tumor is 2–5 centimeters but cancer may have spread to the axillary lymph nodes. By Stage III, metastasis to the lymph nodes is typical, and tumors are ≧5 centimeters. Additional tissue involvement (skin, chest wall, ribs, muscles etc.) may also be noted. Once cancer has spread to additional organs of the body, it is classed as Stage IV.

Almost all breast cancers (>90%) are detected at Stage I or II, but 31% of these are already lymph node positive. The 5-year survival rate for node negative patients (with standard surgery/radiation/chemotherapy /hormone regimens) is 97%; however, involvement of the lymph nodes reduces the 5-year survival to only 77%. Involvement of other organs (≧Stage III) drastically reduces the overall survival, to 22% at 5 years. Thus, chance of recovery from breast cancer is highly dependent on early detection. Because up to 10% of breast cancers are hereditary, those with a family history are considered to be at high risk for breast cancer and should be monitored very closely.

Therapy

Breast cancer is highly treatable and often curable when detected in the early stages. (For a complete review of breast cancer treatments, see the NCI PDQ for Breast Cancer.) Common therapies include surgery, radiation therapy, chemotherapy and hormonal therapy. Depending upon many factors, including the tumor size, lymph node involvement and location of the lesion, surgical removal varies from lumpectomy (removal of the tumor and some surrounding tissue) to mastectomy (removal of the breast, lymph nodes and some or all of the underlying chest muscle). Even with successful surgical resection, as many as 21% of the patients may ultimately relapse (10–20 years). Thus, once local disease is controlled by surgery, adjuvant radiation treatments, chemotherapies and/or hormonal therapies are typically used to reduce the rate of recurrence and improve survival. The therapy regimen employed depends not only on the stage of the cancer at its time of removal, but other variables such the type of cancer (ductal or lobular), whether lymph nodes were involved and removed, age and general health of the patient and if other organs are involved.

Common chemotherapies include various combinations cytotoxic drugs to kill the cancer cells. These drugs include paclitaxel (Taxol), docetaxel, cisplatin, methotrexate, cyclophosphamide, doxorubicin, fluorouracil etc. Significant toxicities are associated with these cytotoxic therapies. Well-characterized toxicities include nausea and vomiting, myelosuppression, alopecia and mucosity. Serious cardiac problems are also associated with certain of the combinations, e.g. doxorubin and paclitaxel, but are less common.

Testing for estrogen and progesterone receptors helps to determine whether certain anti-hormone therapies might be helpful in inhibiting tumor growth. If either or both receptors are present, therapies to interfere with the action of the hormone ligands, can be given in combination with chemotherapy and are generally continued for several years. These adjuvant therapies are called SERMs, selective estrogen receptor modulators, and they can give beneficial estrogen-like effects on bone and lipid metabolism while antagonizing estrogen in reproductive tissues. Tamoxifen is one such compound. The primary toxic effect associated with the use of tamoxifen is a 2 to 7-fold increase in the rate of endometrial cancer. Blood clots in the legs and lung and the possibility of stroke are additional side effects. However, tamoxifen has been determined to reduce breast cancer incidence by 49% in high-risk patients and an extensive, somewhat controversial, clinical study is underway to expand the prophylactic use of tamoxifen. Another SERM, raloxifene, was also shown to reduce the incidence of breast cancer in a large clinical trial where it was being used to treat osteoporosis. In additional studies, removal of the ovaries and/or drugs to keep the ovaries from working are being tested.

Bone marrow transplantation is being studied in clinical trials for breast cancers that have become resistant to traditional chemotherapies or where>3 lymph nodes are involved. Marrow is removed from the patient prior to high-dose chemotherapy to protect it from being destroyed, and then replaced after the chemotherapy. Another type of "transplant" involves the exogenous treatment of peripheral blood stem cells with drugs to kill cancer cells prior to replacing the treated cells in the bloodstream.

One biological treatment, a humanized monoclonal anti-HER2 antibody, Herceptin® (Genentech) has been approved by the FDA as an additional treatment for HER2 positive tumors. Herceptin® binds with high affinity to the extracellular domain of HER2 and thus blocks its signaling action. Herceptin® can be used alone or in combination with chemotherapeutics (i.e. paclitaxel, docetaxel, cisplatin, etc.) (Pegram, et al., 1998). In Phase III studies, Herceptin® significantly improved the response rate to chemotherapy as well as improving the time to progression (Ross & Fletcher, 1998). The most common side effects attributed to Herceptin® are fever and chills, pain, asthenia, nausea, vomiting, increased cough, diarrhea, headache, dyspnea, infection, rhinitis, and insomnia. Herceptin® in combination with chemotherapy (paclitaxel) can lead to cardiotoxicity (Sparano, 1999), leukopenia, anemia, diarrhea, abdominal pain and infection.

HER2 Protein Levels for Patient Screening and as a Potential Endpoint

Because elevated HER2 levels can be detected in at least 30% of breast cancers, breast cancer patients can be pre-screened for elevated HER2 prior to admission to initial clinical trials testing an anti-HER2 ribozyme. Initial HER2 levels can be determined (by ELISA) from tumor biopsies or resected tumor samples.

During clinical trials, it may be possible to monitor circulating HER2 protein by ELISA (Ross and Fletcher, 1998). Evaluation of serial blood/serum samples over the course of the anti-HER2 ribozyme treatment period could be useful in determining early indications of efficacy. In fact, the clinical course of Stage IV breast cancer was correlated with shed HER2 protein fragment following a dose-intensified paclitaxel monotherapy. In all responders, the HER2 serum level decreased below the detection limit (Luftner et al.).

Two cancer-associated antigens, CA27.29 and CA15.3, can also be measured in the serum. Both of these glycoproteins have been used as diagnostic markers for breast cancer. CA27.29 levels are higher than CA15.3 in breast cancer patients; the reverse is true in healthy individuals. Of these two markers, CA27.29 was found to better discriminate primary cancer from healthy subjects. In addition, a statistically significant and direct relationship was shown between CA27.29 and large vs small tumors and node postive vs node negative disease (Gion, et al., 1999). Moreover, both cancer antigens were found to be suitable for the detection of possible metastases during follow-up (Rodriguez de Paterna et al., 1999). Thus, blocking breast tumor growth may be reflected in lower CA27.29 and/or CA15.3 levels compared to a control group. FDA submissions for the use of CA27.29 and CA15.3 for monitoring metastatic breast cancer patients have been filed (reviewed in Beveridge, 1999). Fully automated methods for measurement of either of these markers are commercially available.

REFERENCES

Baselga, J., Norton, L. Albanell, J., Kim, Y. M. and Mendelsohn, J. (1998) Recombinant humanized anti-HER2 antibody (Herceptin) enhances the antitumor activity of paclitaxel and doxorubicin against HER2/neu over-expressing human breast cancer xenografts. *Cancer Res.* 15: 2825–2831.

Berchuck, A. Kamel, A., Whitaker, R. et al. (1990) Overexpression of her-2/neu is associated with poor survival in advanced epithelial ovarian cancer. Cancer Research 50: 4087–4091.

Bertram, J. Killian, M., Brysch, W., Schlingensiepen, K.-H., and Kneba, M. (1994) Reduction of erbB2 gene product in mamma carcinoma cell lines by erbB2 mRNA-specific and tyrosine kinase consensus phosphorothioate antisense oligonucleotides. *Biochem. BioPhys. Res. Comm.* 200: 661–667.

Beveridge, R. A. (1999) Review of clinical studies of CA27.29 in breast cancer management. *Int. J. Biol. Markers* 14: 36–39.

Colomer, R., Lupu, R., Bacus, S. S. and Gelmann, E. P. (1994) erbB-2 antisense oligonucloetides inhibit the proliferation of breast carcinoma cells with erbB-2 oncogene amplification. *British J. Cancer* 70: 819–825.

Czubayko, F., Downing, S. G., Hsieh, S. S., Goldstein, D. J., Lu P. Y., Trapnell, B. C. and Wellstein, A. (1997) Adenovirus-mediated transduction of ribozymes abrogates HER-2/neu and pleiotrophin expression and inhibits tumor cell proliferation. *Gene Ther.* 4: 943–949.

Gion, M., Mione, R., Leon, A. E. and Dittadi, R. (1999) Comparison of the diagnostic accuracy of CA27.29 and CA15.3 in primary breast cancer. *Clin. Chem.* 45: 630–637.

Hung, M.-C., Matin, A., Zhang, Y., Xing, X., Sorgi, F., Huang, L. and Yu, D. (1995) HER-2/neu-targeting gene therapy—a review. *Gene* 159: 65–71.

Luftner, D., Schnabel. S. and Possinger, K. (1999) c-erbB-2 in serum of patients receiving fractionated paclitaxel chemotherapy. *Int. J. Biol. Markers* 14: 55–59.

McGuire, H. C. and Greene, M. I. (1989) The neu (c-erbB-2) oncogene. *Semin. Oncol.* 16: 148–155.

NCI PDQ/Treatment/Health Professionals/Breast Cancer: http://cancemet.nci.nih.gov/clinpdq/soa/Breast_cancer_Physician.html NCI PDQ/Treatment/Patients/Breast Cancer: http://cancemet.nci.nih.gov/clinpdq/pif/Breast_cancer_Patient.html Pegram, M. D., Lipton, A., Hayes, D. F., Weber, B. L., Baselga, J. M., Tripathy, D., Baly, D., Baughman, S. A., Twaddell, T., Glaspy, J. A. and Slamon, D. J. (1998) Phase II study of receptor-enhanced chemosensitivity using recombinant humanized anti-p185HER2/neu monoclonal antibody plus cisplatin in patients with HER2/neu-overexpressing metastatic breast cancer refractory to chemotherapy treatment. *J. Clin. Oncol.* 16: 2659–2671.

Rodriguez de Patena, L., Arnaiz, F., Estenoz, J. Ortuno, B. and Lanzos E. (1999) Study of serum tumor markers CEA, CA15.3, CA27.29 as diagnostic parameters in patients with breast carcinoma. *Int. J. Biol. Markers* 10: 24–29.

Ross, J. S. and Fletcher, J. A. (1998) The HER-2/neu oncogene in breast cancer: Prognostic factor, predictive factor and target for therapy. Oncologist 3: 1998.

Slamon, D. J., Clark, G. M., Wong, S. G., Levin, W. J., Ullrich, A. and McGuire, W. L. (1987) Human breast cancer: correlation of relapse and survival with amplification of the HER-2/neu oncogene. *Science* 235: 177–182.

Sparano, J. A. (1999) Doxorubicin/taxane combinations: Cardiac toxicity and pharmacokinetics. *Semin. Oncol.* 26: 14–19.

Surveillance, Epidemiology and End Results Program (SEER) Cancer Statistics Review: http://www.seer.ims.nci.nih.gov/Publications/CSR1973_1996/

Suzuki T., Curcio, L. D., Tsai, J. and Kashani-Sabet M. (1997) Anti-c-erb-B-2 Ribozyme for Breast Cancer. In *Methods in Molecular Medicine*, Vol. 11, Therapeutic Applications of Ribozmes, Human Press, Inc., Totowa, N.J.

Vaughn, J. P., Iglehart, J. D., Demirdji, S., Davis, P., Babiss, L. E., Caruthers, M. H., Marks, J. R. (1995) Antisense DNA downregulation of the ERBB2 oncogene measured by a flow cytometric assay. *Proc Natl Acad Sci USA* 92: 8338–8342.

Weichen, K., Zimmer, C. and Dietel, M. (1997) Selection of a high activity c-erbB2 ribozyme using a fusion gene of c-erbB-2 and the enhanced green fluorescent protein. *Cancer Gene Therapy* 5: 45–51.

Wright, M., Grim, J., Deshane, J., Kim, M., Strong, T. V., Siegel, G. P., Curiel, D. T. (1997) An intracellular anti-erbB-2 single-chain antibody is specifically cytotoxic to human breast carcinoma cells overexpressing erbB-2. *Gene Therapy* 4: 317–322.

Applicant has designed, synthesized and tested several class II (zinzyme) ribozymes targeted against HER2 RNA (see for example Tables XV and XVI) in cell proliferation assays.

Proliferation Assay

The model proliferation assay used in the study requires a cell-plating density of 2000 cells/well in 96-well plates and at least 2 cell doublings over a 5-day treatment period. To calculate cell density for proliferation assays, the FIPS (fluoro-imaging processing system) method well known in the art was used. This method allows for cell density measurements after nucleic acids are stained with CyQuant® dye, and has the advantage of accurately measuring cell densities over a very wide range 1,000–100,000 cells/well in 96-well format.

Ribozymes (50–200 nM) were delivered in the presence of cationic lipid at 2.0 µg/mL and inhibition of proliferation was determined on day 5 post-treatment. Two full ribozyme screens were completed resulting in the selection of 14 ribozymes. Class II (zinzyme) ribozymes against sites, 314 (RPI No. 18653), 443 (RPI No. 18680), 597 (RPI No. 18697), 659 (RPI No. 18682), 878 (RPI Nos. 18683 and 18654), 881 (RPI Nos. 18684 and 18685) 934 (RPI No. 18651), 972 (RPI No. 18656, 19292, 19727, and 19728), 1292 (RPI No. 18726), 1541 (RPI No. 18687), 2116 (RPI No. 18729), 2932 (RPI No. 18678), 2540 (RPI No. 18715), and 3504 (RPI No. 18710) caused inhibition of proliferation ranging from 25–80% as compared to a scrambled control ribozyme. An example of results from a cell culture assay is shown in FIG. 11. Referring to FIG. 11, Class II ribozymes targeted against HER2 RNA are shown to cause significant inhibition of proliferation of cells. This shows that ribozymes, for instance the Class II (zinzyme) ribozymes are capable of inhibiting HER gene expression in mammalian cells.

Example 20

Reduction of Ribose Residues in Class II (zinzyme) Nucleic Acid Catalysts

Class II (zinzyme) nucleic acid catalysts were tested for their activity as a function ribonucleotide content. A Zinzyme having no ribonucleotide residue (ie., no 2'-OH group at the 2' position of the nucleotide sugar) against the K-Ras site 521 was designed. This molecules were tested utilizing the chemistry shown in FIG. 18a. The in vitro catalytic activity zinzyme construct was not significantly effected (the cleavage rate reduced only 10 fold).

The Kras zinzyme shown in FIG. 18a was tested in physiological buffer with the divalent concentrations as indicated in the legend (high NaCl is an altered monovalent condition shown) of FIG. 19. The 1 mM $Ca^{++}$ condition yielded a rate of 0.005 $min^{-1}$ while the 1 mM $Mg^{++}$ condition yielded a rate of 0.002 $min^{-1}$. The ribose containing wild type yields a rate of 0.05 mind while substrate in the absence of zinzyme demonstrates less than 2% degradation at the longest time point under reaction conditions shown. This illustrates a well-behaved cleavage reaction done by a non-ribose containing catalyst with only a 10-fold reduced cleavage as compared to ribonucleotide-containing zinzyme and vastly above non-catalyzed degradation.

A more detailed investigation into the role of ribose positions in the Class II (zinzyme) motif was carried out in the context of the HER2 site 972 (Applicant has further designed a fully modified Zinzyme as shown in FIG. 18b targeting the HER2 RNA site 972). FIG. 20 is a diagram of the alternate formats tested and their relative rates of catalysis. The effect of substitution of ribose G for the 2'-O-methyl C-2'-O-methyl A in the loop of Zinzyme was insignificant when assayed with the Kras target but showed a modest rate enhancement in the HER2 assays. The activity of all Zinzyme motifs, including the fully stabilized "0 ribose" are well above background noise level degradation. Zinzyme with only two ribose positions are sufficient to restore "wild-type" activity. Motifs containing 3, 4 or 5 ribose positions demonstrated a greater extent of cleavage and profiles almost identical to the 2 ribose motif. Applicant has thus demonstrated that a Zinzyme with no ribonucleotides present at any position can catalyze efficient RNA cleavage activity. Thus, Zinzyme enzymatic nucleic acid molecules do not require the presence of 2'-OH group within the molecule for catalytic activity.

Example 21

Activity of Reduced Ribose Containing Class II (zinzyme) Nucleic Acid Catalysts to Inhibit HER2 Gene Expression A cell proliferation assay for testing reduced ribo class II (zinzyme) nucleic acid catalysts (100–200 nM) targeting HER2 site 972 was performed as described in example 19. Single ribonucleotide containing Zinzyme (RPI No 19728) showed cell proliferation inhibition of between 37% and 67%, and fully stabilized non-ribonucleotide containing Zinzyme (RPI No. 19727) showed cell proliferation inhibition of between 38% and 65% compared to scrambled attenuated controls. The seven-ribonucleotide Zinzyme (RPI No. 19292) demonstrated the same level of inhibition as the single ribo/non-ribo derivatives. These results indicate significant inhibition of HER2 gene expression using stabilized Class II (zinzyme) motifs, including one ribo and non-ribo containing nucleic acid catalysts.

Applications

The use of NTP's described in this invention have several research and commercial applications. These modified nucleotide triphosphates can be used for in vitro selection (evolution) of oligonucleotides with novel functions. Examples of in vitro selection protocols are as follows: Joyce, 1989, *Gene,* 82, 83–87; Beaudry et al., 1992, *Science* 257, 635–641; Joyce, 1992, *Scientific American* 267, 90–97; Breaker et al., 1994, *TIBTECH* 12, 268; Bartel et al., 1993, *Science* 261:1411–1418; Szostak, 1993, *TIBS* 17, 89–93; Kumar et al., 1995, *FASEB J.,* 9, 1183; Breaker, 1996, *Curr. Op. Biotech.,* 7, 442.

Additionally, these modified nucleotide triphosphates can be employed to generate modified oligonucleotide combinatorial chemistry libraries. Several references for this technology exist (Brenner et al., 1992, *PNAS* 89, 5381–5383, Eaton, 1997, *Curr. Opin. Chem. Biol.* 1, 10–16).

Diagnostic Uses

Enzymatic nucleic acid molecules of this invention may be used as diagnostic tools to examine genetic drift and mutations within diseased cells or to detect the presence of specific RNA in a cell. The close relationship between enzymatic nucleic acid molecule activity and the structure of the target RNA allows the detection of mutations in any region of the molecule which alters the base-pairing and three-dimensional structure of the target RNA. By using multiple enzymatic nucleic acid molecules described in this invention, one may map nucleotide changes which are important to RNA structure and function in vitro, as well as in cells and tissues. Cleavage of target RNAs with enzymatic nucleic acid molecules may be used to inhibit gene expression and define the role (essentially) of specified gene products in the progression of disease. In this manner, other genetic targets may be defined as important mediators of the disease. These experiments will lead to better treatment of the disease progression by affording the possibility of combinational therapies (e.g., multiple enzymatic nucleic acid molecules targeted to different genes, enzymatic nucleic acid molecules coupled with known small molecule inhibitors, radiation or intermittent treatment with combinations of enzymatic nucleic acid molecules and/or other chemical or biological molecules). Other in vitro uses of enzymatic nucleic acid molecules of this invention are well known in the art, and include detection of the presence of mRNAs associated with related conditions. Such RNA is detected by determining the presence of a cleavage product after treatment with a enzymatic nucleic acid molecule using standard methodology.

In a specific example, enzymatic nucleic acid molecules which can cleave only wild-type or mutant forms of the target RNA are used for the assay. The first enzymatic nucleic acid molecule is used to identify wild-type RNA present in the sample and the second enzymatic nucleic acid molecule will be used to identify mutant RNA in the sample. As reaction controls, synthetic substrates of both wild-type and mutant RNA will be cleaved by both enzymatic nucleic acid molecules to demonstrate the relative enzymatic nucleic acid molecule efficiencies in the reactions and the absence of cleavage of the "non-targeted" RNA species. The cleavage products from the synthetic substrates will also serve to generate size markers for the analysis of wild type and mutant RNAs in the sample population. Thus each analysis can involve two enzymatic nucleic acid molecules, two substrates and one unknown sample which can be combined into six reactions. The presence of cleavage products can be determined using an RNAse protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype is adequate to establish risk. If probes of comparable specific activity are used for both transcripts, then a qualitative comparison of RNA levels will be adequate and will decrease the cost of the initial diagnosis. Higher mutant form to wild-type ratios will be correlated with higher risk whether RNA levels are compared qualitatively or quantitatively.

Additional Uses

Potential usefulness of sequence-specific enzymatic nucleic acid molecules of the instant invention can have many of the same applications for the study of RNA that DNA restriction endonucleases have for the study of DNA (Nathans et al., 1975 *Ann. Rev. Biochem.* 44:273). For example, the pattern of restriction fragments can be used to establish sequence relationships between two related RNAs, and large RNAs could be specifically cleaved to fragments of a size more useful for study. The ability to engineer sequence specificity of the enzymatic nucleic acid molecule is ideal for cleavage of RNAs of unknown sequence. Applicant describes the use of nucleic acid molecules to down-regulate gene expression of target genes in bacterial, microbial, fungal, viral, and eukaryotic systems including plant, or mammalian cells.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications may be made to the invention disclosed herein without departing from the scope and spirit of the invention. Thus, such additional embodiments are within the scope of the present invention and the following claims.

The invention illustratively described herein suitably may be practiced in the absence of any element or elements, limitation or limitations which is not specifically disclosed herein. Thus, for example, in each instance herein any of the terms "comprising", "consisting essentially of" and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

Thus, additional embodiments are within the scope of the invention and within the following claims.

TABLE I

NUCLEOSIDES USED FOR CHEMICAL SYNTHESIS OF MODIFIED NUCLEOTIDE TRIPHOSPHATES

| | NUCLEOSIDES | Abbreviation | CHEMICAL STRUCTURE |
|---|---|---|---|
| 1 | 2'-O-methyl-2,6-diaminopurine riboside | 2'-O-Me-DAP | 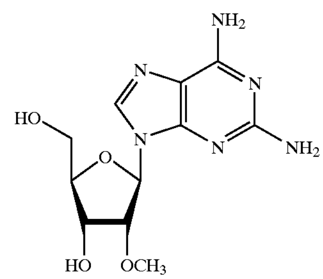 |
| 2 | 2'-deoxy-2'amino-2,6-diaminopurine riboside | 2'-NH$_2$-DAP | 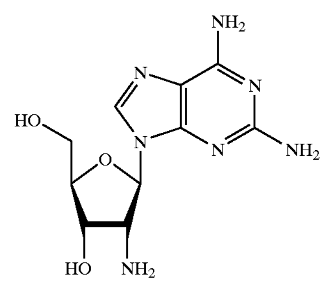 |
| 3 | 2'-(N-alanyl)amino-2'-deoxy-uridine | ala-2'-NH$_2$ U | 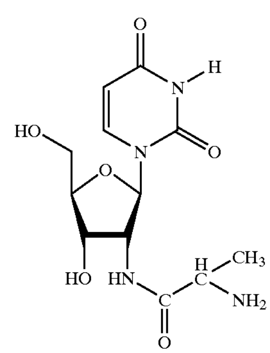 |

TABLE I-continued

NUCLEOSIDES USED FOR CHEMICAL SYNTHESIS OF MODIFIED NUCLEOTIDE TRIPHOSPHATES

| NUCLEOSIDES | Abbreviation | CHEMICAL STRUCTURE |
|---|---|---|
| 4  2'-(N-phenylalanyl)amino-2'-deoxy-uridine | phe-2'-NH$_2$-U | |
| 5  2'-(N-β-alanyl) amino-2'-deoxy uridine | 2'-β-Ala-NH$_2$-U | |
| 6  2'-Deoxy-2'-(lysiyl) amino uridine | 2'-L-lys-NH$_2$-U | |
| 7  2'-C-allyl uridine | 2'-C-allyl-U | |

TABLE I-continued

NUCLEOSIDES USED FOR CHEMICAL SYNTHESIS OF MODIFIED NUCLEOTIDE TRIPHOSPHATES

| NUCLEOSIDES | Abbreviation | CHEMICAL STRUCTURE |
| --- | --- | --- |
| 8  2'-O-amino-uridine | 2'-O-NH$_2$-U | |
| 9  2'-O-methylthiomethyl adenosine | 2'-O-MTM-A | |
| 10  2'-O-methylthiomethyl cytidine | 2'-O-MTM-C | |
| 11  2'-O-methylthiomethyl guanosine | 2'-O-MTM-G | |

TABLE I-continued

NUCLEOSIDES USED FOR CHEMICAL SYNTHESIS OF MODIFIED NUCLEOTIDE TRIPHOSPHATES

| NUCLEOSIDES | Abbreviation | CHEMICAL STRUCTURE |
| --- | --- | --- |
| 12 2'-O-methylthiomethyl-uridine | 2'-O-MTM-U | 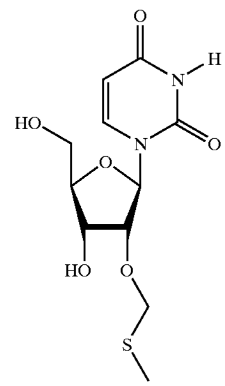 |
| 13 2'-(N-histidyl) amino uridine | 2'-his-NH$_2$-U | 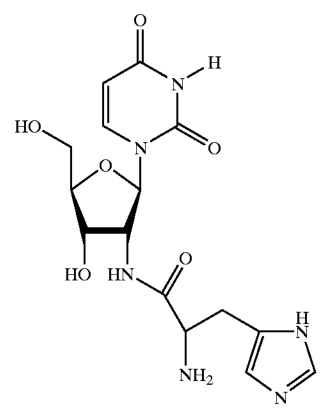 |
| 14 2'-Deoxy-2'-amino-5-methyl cytidine | 5-Me-2'-NH$_2$-C | 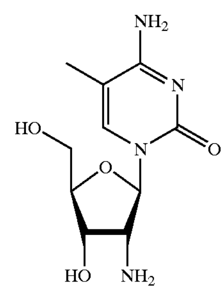 |
| 15 2'-(N-β-carboxamidine-β-alanyl)amino-2'-deoxy-uridine | β-ala-CA-NH$_2$-U | 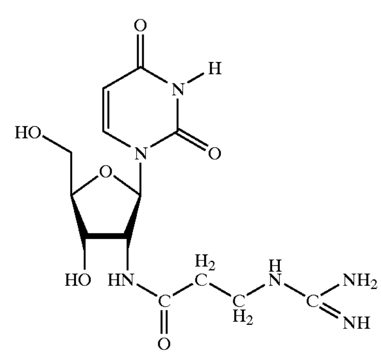 |

TABLE I-continued

NUCLEOSIDES USED FOR CHEMICAL SYNTHESIS OF MODIFIED NUCLEOTIDE TRIPHOSPHATES

| NUCLEOSIDES | Abbreviation | CHEMICAL STRUCTURE |
| --- | --- | --- |
| 16 2'-(N-β-alanyl) guanosine | β-Ala-NH$_2$-G | 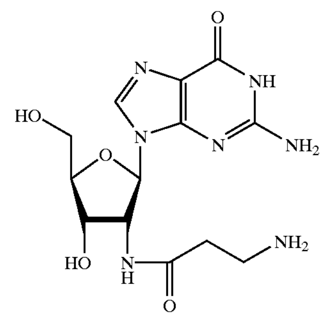 |
| 17 2'-O-Amino-Uridine | 2'-O-NH$_2$U | 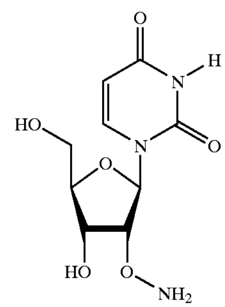 |
| 18 2'-(N-lysyl)amino-2'-deoxy-cytidine | 2'-NH$_2$-lys-C | 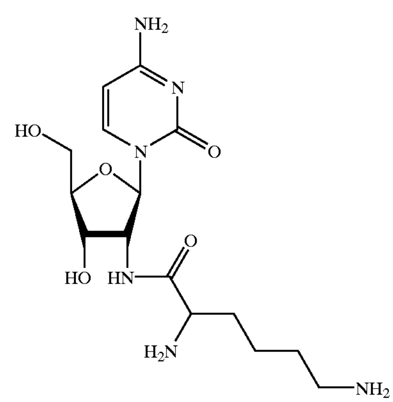 |
| 19 2'-Deoxy-2'-(L-histidine) amino Cytidine | 2'-NH$_2$-his-C | 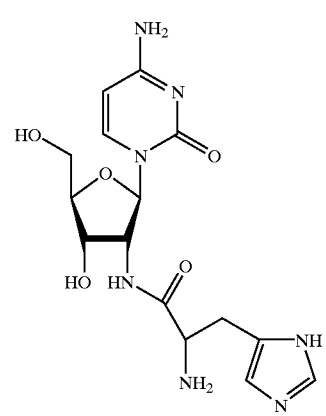 |

TABLE I-continued

NUCLEOSIDES USED FOR CHEMICAL SYNTHESIS OF MODIFIED NUCLEOTIDE TRIPHOSPHATES

| NUCLEOSIDES | Abbreviation | CHEMICAL STRUCTURE |
|---|---|---|
| 20 5-Imidazoleacetic acid 2'-deoxy uridine | 5-IAA-U | 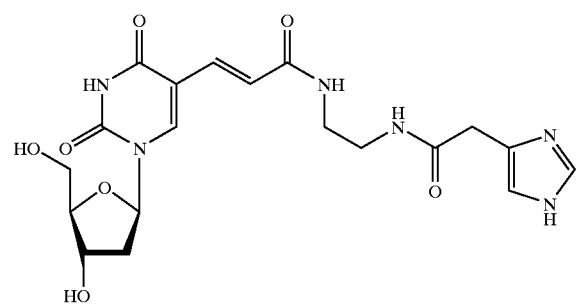 |
| 21 5-[3-(N-4-imidazoleacetyl)amino propynyl]--2'-O-methyl uridine | 5-IAA-propynylamino-2'-OMe U | 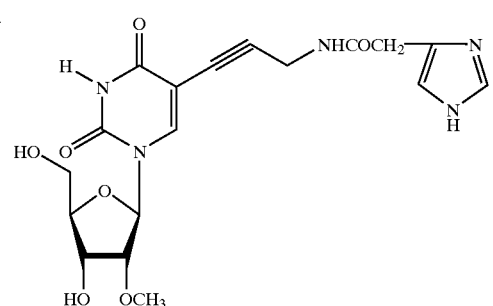 |
| 22 5-(3-aminopropynyl)-2'-O-methyl uridine | 5-aminopropynyl-2'-OMe U | 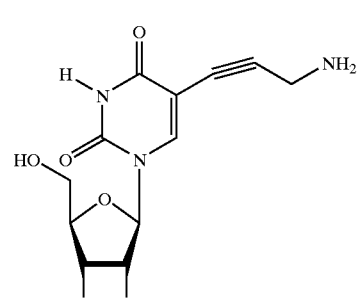 |
| 23 5-(3-aminopropyl)-2'-O-methyl uridine | 5-aminopropyl-2'-OMe U | 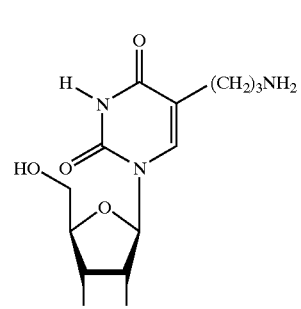 |
| 24 5-[3-(N-4-imidazoleacetyl)amino propyl]-2'-O-methyl Uridine | 5-IAA-propylamino-2'-OMe U | 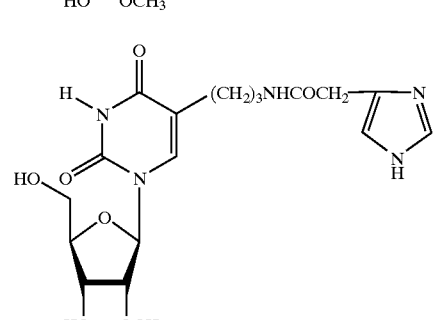 |

TABLE I-continued

| NUCLEOSIDES USED FOR CHEMICAL SYNTHESIS OF MODIFIED NUCLEOTIDE TRIPHOSPHATES | | |
|---|---|---|
| NUCLEOSIDES | Abbreviation | CHEMICAL STRUCTURE |
| 25  5-(3-aminopropyl)-2'-deoxy-2-fluoro uridine | 5-aminopropyl-2'-F dU | |
| 26  2'-Deoxy-2'-(β-alanyl-L-histidyl)amino Uridine | 2'-amino-β-ALA HIS dU | |
| 27  2'-deoxy-2'-β-alaninamido-uridine | 2'-β-ALA dU | |
| 28  3-(2'-deoxy-2'-fluoro-β-D-ribofuranosyl) piperazino[2,3-D]pyrimidine-2-one | 2'-F piperazino-pyrimidinone | |
| 29  5-[3-(N-4-imidazoleacetyl)amino propyl]-2'-deoxy-2'-fluoro Uridine | 5-IAA-propylamino-2'-F dU | |

TABLE I-continued

NUCLEOSIDES USED FOR CHEMICAL SYNTHESIS OF MODIFIED NUCLEOTIDE TRIPHOSPHATES

| | NUCLEOSIDES | Abbreviation | CHEMICAL STRUCTURE |
|---|---|---|---|
| 30 | 5-[3-(N-4-imidazoleacetyl)amino propynyl]-2'-deoxy-2'-fluoro uridine | 5-IAA-propynyl-amino-2'-F dU | 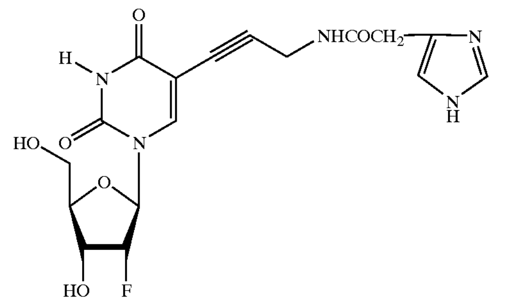 |
| 31 | 5-E-(2-carboxyvinyl-2'-deoxy-2'-fluoro uridine | 5-carboxyvinyl-2'-F dU | 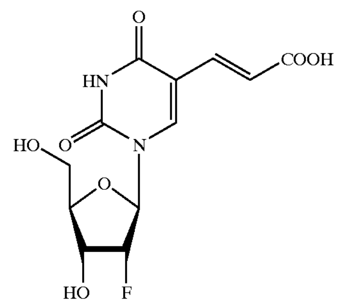 |
| 32 | 5-[3-(N-4-aspartyl)aminopropynyl-2'-fluoro uridine | 5-ASP-aminopropyl-2'-F-dU | 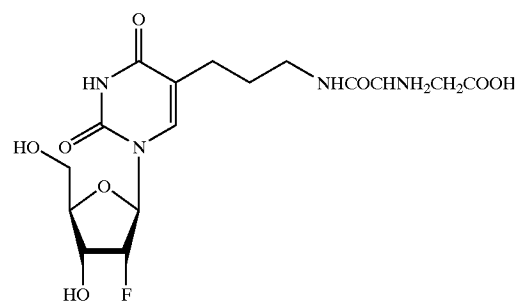 |
| 33 | 5-(3-aminopropyl)-2'-deoxy-2-fluoro cytidine | 5-aminopropyl-2'-F dC | 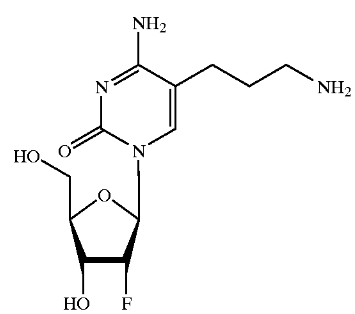 |
| 34 | 5-[3-(N-4-succynyl)aminopropyl-2'-deoxy-2-fluoro cytidine | 5-succynylamino-propyl-2'-F dC | 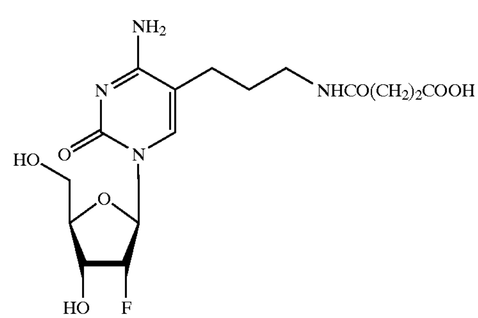 |

TABLE II

| Reagent | Equivalents | Amount | Wait Time* 2'-O-methyl | Wait Time* RNA |
|---|---|---|---|---|
| A. 2.5 pmol Synthesis Cycle ABI 394 Instrument | | | | |
| Phosphoramidites | 6.5 | 163 μL | 2.5 min | 7.5 |
| S-Ethyl Tetrazole | 23.8 | 238 μL | 2.5 min | 7.5 |
| Acetic Anhydride | 100 | 233 μL | 5 sec | 5 sec |
| N-Methylimidazole | 186 | 233 μL | 5 sec | 5 sec |
| TCA | 110.1 | 2.3 mL | 21 sec | 21 sec |
| Iodine | 11.2 | 1.7 mL | 45 sec | 45 sec |
| Acetonitrile | NA | 6.67 mL | NA | NA |
| B. 0.2 pmol Synthesis Cycle ABI 394 Instrument | | | | |
| Phosphoramidites | 15 | 31 μL | 233 sec | 465 sec |
| S-Ethyl Tetrazole | 38.7 | 31 μL | 233 min | 465 sec |
| Acetic Anhydride | 655 | 124 μL | 5 sec | 5 sec |
| N-Methyl Imidazole | 1245 | 124 μL | 5 sec | 5 sec |
| TCA | 700 | 732 μL | 10 sec | 10 sec |
| Iodine | 20.6 | 244 μL | 15 sec | 15 sec |
| Acetonitrile | NA | 2.64 mL | NA | NA |

| Reagent | Equivalents 2'-O-methyl/Ribo | Amount 2'-O-methyl/Ribo | Wait Time* 2'-O-methyl | Wait Time* Ribo |
|---|---|---|---|---|
| C. 0.2 pmol Synthesis Cycle 96 well Instrument | | | | |
| Phosphoramidites | 33/66 | 60/120 μL | 233 sec | 465 sec |
| S-Ethyl Tetrazole | 75/150 | 60/120 μL | 233 min | 465 sec |
| Acetic Anhydride | 50/50 | 50/50 μL | 10 sec | 10 sec |
| N-Methyl Imidazole | 502/502 | 50/50 μL | 10 sec | 10 sec |
| TCA | 16,000/16,000 | 500/500 μL | 15 sec | 15 sec |
| Iodine | 6.8/6.8 | 80/80 μL | 30 sec | 30 sec |
| Acetonitrile | NA | 850/850 μL | NA | NA |

*Wait time does not include contact time during delivery.

TABLE III

PHOSPHORYLATION OF URIDINE IN THE PRESENCE OF DMAP

| 0 equiv. DMAP | | 0.2 equiv. DMAP | | 0.5 equiv. DMAP | | 1.0 equiv. DMAP | |
|---|---|---|---|---|---|---|---|
| Time (min) | Product % | Time (min) | Product % | Time (min) | Product % | Time (min) | Product % |
| 0 | 1 | 0 | 0 | 0 | 0 | 0 | 0 |
| 40 | 7 | 10 | 8 | 20 | 27 | 30 | 74 |
| 80 | 10 | 50 | 24 | 60 | 46 | 70 | 77 |
| 120 | 12 | 90 | 33 | 100 | 57 | 110 | 84 |
| 160 | 14 | 130 | 39 | 140 | 63 | 150 | 83 |
| 200 | 17 | 170 | 43 | 180 | 63 | 190 | 84 |
| 240 | 19 | 210 | 47 | 220 | 64 | 230 | 77 |
| 320 | 20 | 250 | 48 | 260 | 68 | 270 | 79 |
| 1130 | 48 | 290 | 49 | 300 | 64 | 310 | 77 |
| 1200 | 46 | 1140 | 68 | 1150 | 76 | 1160 | 72 |
| | | 1210 | 69 | 1220 | 76 | 1230 | 74 |

TABLE IV

Detailed Description of the NTP Incorporation Reaction Conditions

| Condition No. | TRIS-HCL (mM) | MgCl₂ (mM) | DTT (mM) | Spermidine (mM) | Triton X-100 (%) | METHANOL (%) | LiCl (mM) | PEG (%) | Temp (° C.) |
|---|---|---|---|---|---|---|---|---|---|
| 1 | 40 (pH 8.0) | 20 | 10 | 5 | 0.01 | 10 | 1 | — | 25 |
| 2 | 40 (pH 8.0) | 20 | 10 | 5 | 0.01 | 10 | 1 | 4 | 25 |
| 3 | 40 (pH 8.1) | 12 | 5 | 1 | 0.002 | — | — | 4 | 25 |
| 4 | 40 (pH 8.1) | 12 | 5 | 1 | 0.002 | 10 | — | 4 | 25 |
| 5 | 40 (pH 8.1) | 12 | 5 | 1 | 0.002 | — | 1 | 4 | 25 |
| 6 | 40 (pH 8.1) | 12 | 5 | 1 | 0.002 | 10 | 1 | 4 | 25 |
| 7 | 40 (pH 8.0) | 20 | 10 | 5 | 0.01 | 10 | 1 | — | 37 |
| 8 | 40 (pH 8.0) | 20 | 10 | 5 | 0.01 | 10 | 1 | 4 | 37 |
| 9 | 40 (pH 8.1) | 12 | 5 | 1 | 0.002 | — | — | 4 | 37 |
| 10 | 40 (pH 8.1) | 12 | 5 | 1 | 0.002 | 10 | — | 4 | 37 |
| 11 | 40 (pH 8.1) | 12 | 5 | 1 | 0.002 | — | 1 | 4 | 37 |
| 12 | 40 (pH 8.1) | 12 | 5 | 1 | 0.002 | 10 | 1 | 4 | 37 |

TABLE V

INCORPORATION OF MODIFIED NUCLEOTIDE TRIPHOSPHATES

| Modification | COND# 1 | COND# 2 | COND# 3 | COND# 4 | COND# 5 | COND# 6 | COND# 7 | COND# 8 | COND# 9 | COND# 10 | COND# 11 | COND# 12 |
|---|---|---|---|---|---|---|---|---|---|---|---|---|
| 2'-NH₂-ATP | 1 | 2 | 3 | 5 | 2 | 4 | 1 | 2 | 10 | 11 | 5 | 9 |
| 2'-NH₂-CTP | 11 | 37 | 45 | 64 | 25 | 70 | 26 | 54 | 292 | 264 | 109 | 244 |
| 2'-NH₂-GTP | 4 | 7 | 6 | 14 | 5 | 17 | 3 | 16 | 10 | 21 | 9 | 16 |
| 2'-NH₂-UTP | 14 | 45 | 4 | 100 | 85 | 82 | 48 | 88 | 20 | 418 | 429 | 440 |
| 2'-dATP | 9 | 3 | 19 | 23 | 9 | 24 | 6 | 3 | 84 | 70 | 28 | 51 |
| 2'-dCTP | 1 | 10 | 43 | 46 | 35 | 47 | 27 | 127 | 204 | 212 | 230 | 235 |
| 2'-dGTP | 6 | 10 | 9 | 15 | 9 | 12 | 8 | 34 | 38 | 122 | 31 | 46 |
| 2'-dTTP | 9 | 9 | 14 | 18 | 13 | 18 | 8 | 15 | 116 | 114 | 59 | 130 |
| 2'-O-Me-ATP | 0 | 0 | 0 | 0 | 0 | 0 | 1 | 1 | 2 | 2 | 2 | 2 |
| 2'-O-Me-CTP | no data compared to ribo; incorporates at low level | | | | | | | | | | | |
| 2'-O-Me-GTP | 4 | 3 | 4 | 4 | 4 | 4 | 2 | 4 | 4 | 5 | 4 | 5 |
| 2'-O-Me-UTP | 55 | 52 | 39 | 38 | 41 | 48 | 55 | 71 | 93 | 103 | 81 | 77 |
| 2'-O-Me-DAP | 4 | 4 | 3 | 4 | 4 | 5 | 4 | 3 | 4 | 5 | 5 | 5 |

TABLE V-continued

INCORPORATION OF MODIFIED NUCLEOTIDE TRIPHOSPHATES

| Modification | COND# 1 | COND# 2 | COND# 3 | COND# 4 | COND# 5 | COND# 6 | COND# 7 | COND# 8 | COND# 9 | COND# 10 | COND# 11 | COND# 12 |
|---|---|---|---|---|---|---|---|---|---|---|---|---|
| 2'-NH$_2$-DAP | 0 | 0 | 1 | 1 | 1 | 1 | 1 | 0 | 0 | 0 | 0 | 0 |
| ala-2'-NH$_2$-UTP | 2 | 2 | 2 | 2 | 3 | 4 | 14 | 18 | 15 | 20 | 13 | 14 |
| phe-2'-NH$_2$-UTP | 8 | 12 | 7 | 7 | 8 | 8 | 4 | 10 | 6 | 6 | 10 | 6 |
| 2'-βNH$_2$-ala-UTP | 65 | 48 | 25 | 17 | 21 | 21 | 220 | 223 | 265 | 300 | 275 | 248 |
| 2'-F-ATP | 227 | 252 | 98 | 103 | 100 | 116 | 288 | 278 | 471 | 198 | 317 | 185 |
| 2'-F-GTP | 39 | 44 | 17 | 30 | 17 | 26 | 172 | 130 | 375 | 447 | 377 | 438 |
| 2'-C-allyl-UTP | 3 | 2 | 2 | 3 | 3 | 2 | 3 | 3 | 3 | 2 | 3 | 3 |
| 2'-O-NH$_2$-UTP | 6 | 8 | 5 | 5 | 4 | 5 | 16 | 23 | 24 | 24 | 19 | 24 |
| 2'-O-MTM-ATP | 0 | 1 | 0 | 0 | 0 | 0 | 1 | 0 | 0 | 0 | 0 | 0 |
| 2'-O-MTM-CTP | 2 | 2 | 1 | 1 | 1 | 1 | 3 | 4 | 5 | 4 | 5 | 3 |
| 2'-O-MTM-GTP | 6 | 1 | 1 | 3 | 1 | 2 | 0 | 1 | 1 | 3 | 1 | 4 |
| 2'-F-CTP | | | | | | | | | 100 | | | |
| 2'-F-UTP | | | | | | | | | 100 | | | |
| 2'-F-TTP | | | | | | | | | 50 | | | |
| 2'-F-C5-carboxyvinyl UTP | | | | | | | | | 100 | | | |
| 2'-F-C5-aspartyl-aminopropyl UTP | | | | | | | | | 100 | | | |
| 2'-F-C5-propylamine CTP | | | | | | | | | 100 | | | |
| 2'-O-Me CTP | | | | | | | | | 0 | | | |
| 2'-O-Me UTP | | | | | | | | | 25 | | | |
| 2'-O-Me 5-3-aminopropyl UTP | | | | | | | | | 4 | | | |
| 2'-O-Me 5-3-aminopropyl UTP | | | | | | | | | 10 | | | |

TABLE VI

INCORPORATION OF MODIFIED NUCLEOTIDE TRIPHOSPHATES USING WILD TYPE BACTERIOPHAGE T7 POLYMERASE

| Modification | label | % ribo control |
|---|---|---|
| 2'-NH$_2$-GTP | ATP | 4% |
| 2'-dGTP | ATP | 3% |
| 2'-O-Me-GTP | ATP | 3% |
| 2'-F-GTP | ATP | 4% |
| 2'-O-MTM-GTP | ATP | 3% |
| 2'-NH$_2$-UTP | ATP | 39% |
| 2'-dTTP | ATP | 5% |
| 2'-O-Me-UTP | ATP | 3% |
| ala-2'-NH$_2$-UTP | ATP | 2% |
| phe-2'-NH$_2$- UTP | ATP | 1% |
| 2'-β-ala-NH$_2$-UTP | ATP | 3% |
| 2'-C-allyl-UTP | ATP | 2% |
| 2'-O-NH$_2$-UTP | ATP | 1% |
| 2'-O-MTM-UTP | ATP | 64% |
| 2'-NH$_2$-ATP | GTP | 1% |
| 2'-O-MTM-ATP | GTP | 1% |
| 2'-NH$_2$-CTP | GTP | 59% |
| 2'-dCTP | GTP | 40% |
| 2'-F-CTP | GTP | 100% |
| 2'-F-UTP | GTP | 100% |
| 2'-F-TTP | GTP | 0% |
| 2'-F-C5-carboxyvinyl UTP | GTP | 100% |
| 2'-F-C5-aspartyl-aminopropyl UTP | GTP | 100% |
| 2'-F-C5-propylamine CTP | GTP | 100% |
| 2'-O-Me CTP | GTP | 0% |
| 2'-O-Me UTP | GTP | 0% |
| 2'-O-Me 5-3-aminopropyl UTP | GTP | 0% |
| 2'-O-Me 5-3-aminopropyl UTP | GTP | 0% |

TABLE VII a: Incorporation of 2'-his-UTP and Modified CTP's

| modification | 2'-his-UTP | rUTP |
|---|---|---|
| CTP | 16.1 | 100 |
| 2'-amino-CTP | 9.5* | 232.7 |
| 2'-deoxy-CTP | 9.6* | 130.1 |
| 2'-OMe-CTP | 1.9 | 6.2 |
| 2'-MTM-CTP | 5.9 | 5.1 |
| control | 1.2 | | b: Incorporation of 2'-his-UTP, 2-amino CTP, and Modified ATP's

| modification | 2'-his-UTP and 2'-amino-CTP | rUTP and rCTP |
|---|---|---|
| ATP | 15.7 | 100 |
| 2'-amino-ATP | 2.4 | 28.9 |
| 2'-deoxy-ATP | 2.3 | 146.3 |
| 2'-OMe-ATP | 2.7 | 15 |
| 2'-F-ATP | 4 | 222.6 |
| 2'-MTM-ATP | 4.7 | 15.3 |
| 2'-OMe-DAP | 1.9 | 5.7 |
| 2'-amino-DAP | 8.9* | 9.6 |

Numbers shown are a percentage of incorporation compared to the all-RNA control
*Bold number indicates best observed rate of modified nucleotide triphosphate incorporation

TABLE VIII

INCORPORATION OF 2'-his-UTP, 2'-NH$_2$-CTP, 2'-NH$_2$-DAP, and rGTP USING VARIOUS REACTION CONDITIONS

| Conditions | compared to all rNTP |
|---|---|
| 7 | 8.7* |
| 8 | 7* |
| 9 | 2.3 |
| 10 | 2.7 |
| 11 | 1.6 |
| 12 | 2.5 |

Numbers shown are a percentage of incorporation compared to the all-RNA control
*Two highest levels of incorporation contained both methanol and LiCl

TABLE IX

Selection of Oligonucleotides with Ribozyme Activity

| pool | Generation | time | substrate remaining (%) | time | Substrate remaining (%) |
|---|---|---|---|---|---|
| N60 | 0 | 4 hr | 100.00 | 24 hr | 100.98 |
| N60 | 14 | 4 hr | 99.67 | 24 hr | 97.51 |
| N60 | 15 | 4 hr | 98.76 | 24 hr | 96.76 |
| N60 | 16 | 4 hr | 97.09 | 24 hr | 96.60 |
| N60 | 17 | 4 hr | 79.50 | 24 hr | 64.01 |
| N40 | 0 | 4 hr | 99.89 | 24 hr | 99.78 |
| N40 | 10 | 4 hr | 99.74 | 24 hr | 99.42 |
| N40 | 11 | 4 hr | 97.18 | 24 hr | 90.38 |
| N40 | 12 | 4 hr | 61.64 | 24 hr | 44.54 |
| N40 | 13 | 4 hr | 54.28 | 24 hr | 36.46 |
| N20 | 0 | 4 hr | 99.18 | 24 hr | 100.00 |
| N20 | 11 | 4 hr | 100.00 | 24 hr | 100.00 |
| N20 | 12 | 4 hr | 99.51 | 24 hr | 100.00 |
| N20 | 13 | 4 hr | 90.63 | 24 hr | 84.89 |
| N20 | 14 | 4 hr | 91.16 | 24 hr | 85.92 |
| N60B | 0 | 4 hr | 100.00 | 24 hr | 100.00 |
| N60B | 1 | 4 hr | 100.00 | 24 hr | 100.00 |
| N60B | 2 | 4 hr | 100.00 | 24 hr | 100.00 |
| N60B | 3 | 4 hr | 100.00 | 24 hr | 100.00 |
| N60B | 4 | 4 hr | 99.24 | 24 hr | 100.00 |
| N60B | 5 | 4 hr | 97.81 | 24 hr | 96.65 |
| N60B | 6 | 4 hr | 89.95 | 24 hr | 77.14 |

TABLE X

Kinetic Activity of Combinatorial Libraries

| Pool | Generation | $k_{obs}$ (min$^{-1}$) |
|---|---|---|
| N60 | 17 | 0.0372 |
|  | 18 | 0.0953 |
|  | 19 | 0.0827 |
| N40 | 12 | 0.0474 |
|  | 13 | 0.037 |
|  | 14 | 0.065 |
|  | 15 | 0.0254 |
| N20 | 13 | 0.0359 |
|  | 14 | 0.0597 |
|  | 15 | 0.0549 |
|  | 16 | 0.0477 |
| N60B | 6 | 0.0209 |
|  | 7 | 0.0715 |
|  | 8 | 0.0379 |

TABLE XI

Kinetic Activity of Clones within N60 and N40 Combinatorial Libraries

| clone | library | activity (min$^{-1}$) | $k_{rel}$ |
|---|---|---|---|
| G18 | N60 | 0.00226 | 1.00 |
| 0-2 | N60 | 0.0389 | 17.21 |
| 0-3 | N60 | 0.000609 | 0.27 |
| 0-5 | N60 | 0.000673 | 0.30 |
| 0-7 | N60 | 0.00104 | 0.46 |
| 0-8 | N60 | 0.000739 | 0.33 |
| 0-11 | N60 | 0.0106 | 4.69 |
| 0-12 | N60 | 0.00224 | 0.99 |
| 0-13 | N60 | 0.0255 | 11.28 |
| 0-14 | N60 | 0.000878 | 0.39 |
| 0-15 | N60 | 0.0000686 | 0.03 |
| 0-21 | N60 | 0.0109 | 4.82 |
| 0-22 | N60 | 0.000835 | 0.37 |
| 0-24 | N60 | 0.000658 | 0.29 |
| 0-28 | N40 | 0.000741 | 0.33 |
| 0-35 | N40 | 0.00658 | 2.91 |
| 3-1 | N40 | 0.0264 | 11.68 |
| 3-3 | N40 | 0.000451 | 0.20 |
| 3-7 | N40 | 0.000854 | 0.38 |
| 3-15 | N40 | 0.000832 | 0.37 |

TABLE XII

Effect of Magnesium Concentration of the Cleavage Rate of N20

| [Mg$^{++}$] | $k_{obs}$ (min$^{-1}$) |
|---|---|
| 25 | 0.0259 |
| 20 | 0.0223 |
| 15 | 0.0182 |
| 10 | 0.0208 |
| 5 | 0.0121 |
| 2 | 0.00319 |
| 2 | 0.00226 |

TABLE XIII

Class I Enzymatic Nucleic Acid Motifs Targeting HCV

| Pos | Target | Seq ID | Alias | Sequence | | Seq ID |
|---|---|---|---|---|---|---|
| 6 | AUGGGGCGACACUCC | 1 | HCV.R1A-6 AmB.Rz-10/5 | ggagugucgc GgaggaaacucC CU UCAAGGACAUCGUCCGGG cccau | B | 39 |
| 56 | UUCACGCAGAAAGCGU | 2 | HCV.R1A-56 AmB.Rz-10/5 | acgcuuucug GgaggaaacucC CU UCAAGGACAUCGUCCGGG gugaa | B | 40 |
| 75 | GCCAUGGCGUUAGUAU | 3 | HCV.R1A-75 AmB.Rz-10/5 | auacuaacgc GgaggaaacucC CU UCAAGGACAUCGUCCGGG auggc | B | 41 |
| 76 | CCAUGGCGUUAGUAUG | 4 | HCV.R1A-76 AmB.Rz-10/5 | cauacuaacg GgaggaaacucC CU UCAAGGACAUCGUCCGGG caugg | B | 42 |
| 95 | GUCGUGCAGCCUCCAG | 5 | HCV.R1A-95 AmB.Rz-10/5 | cuggaggcug GgaggaaacucC CU UCAAGGACAUCGUCCGGG acgac | B | 43 |
| 138 | GGUCUGCGGAACCGGU | 6 | HCV.R1A-138 AmB.Rz-10/5 | accgguuccg GgaggaaacucC CU UCAAGGACAUCGUCCGGG agacc | B | 44 |
| 146 | GAACCGGUGAGUACAC | 7 | HCV.R1A-146 AmB.Rz-10/5 | guguacucac GgaggaaacucC CU UCAAGGACAUCGUCCGGG gguuc | B | 45 |

TABLE XIII-continued

Class I Enzymatic Nucleic Acid Motifs Targeting HCV

| Pos | Target | Seq ID | Alias | Sequence | Seq ID |
|---|---|---|---|---|---|
| 158 | ACACCGGAAUUGCCAG | 8 | HCV.R1A-158<br>AmB.Rz-10/5 | cuggcaauuc GgaggaaacucC CU UCAAGGACAUCGUCCGGG ggugu B | 46 |
| 164 | GAAUUGCCAGGACGAC | 9 | HCV.R1A-164<br>AmB.Rz-10/5 | gucguccugg GgaggaaacucC CU UCAAGGACAUCGUCCGGG aauuc B | 47 |
| 176 | CGACCGGGUCCUUUCU | 10 | HCV.R1A-176<br>AmB.Rz-10/5 | agaaaggacc GgaggaaacucC CU UCAAGGACAUCGUCCGGG ggucg B | 48 |
| 177 | GACCGGGUCCUUUCUU | 11 | HCV.R1A-177<br>AmB.Rz-10/5 | aagaaaggac GgaggaaacucC CU UCAAGGACAUCGUCCGGG cgguc B | 49 |
| 209 | UGCCUGGAGAUUUGGG | 12 | HCV.R1A-209<br>AmB.Rz-10/5 | cccaaaucuc GgaggaaacucC CU UCAAGGACAUCGUCCGGG aggca B | 50 |
| 237 | AGACUGCUAGCCGAGU | 13 | HCV.R1A-237<br>AmB.Rz-10/5 | acucggcuag GgaggaaacucC CU UCAAGGACAUCGUCCGGG agucu B | 51 |
| 254 | GUGUUGGGUCGCGAAA | 14 | HCV.R1A-254<br>AmB.Rz-10/5 | uuucgcgacc GgaggaaacucC CU UCAAGGACAUCGUCCGGG aacac B | 52 |
| 255 | UGUUGGGUCGCGAAAG | 15 | HCV.R1A-255<br>AmB.Rz-10/5 | cuuucgcgac GgaggaaacucC CU UCAAGGACAUCGUCCGGG caaca B | 53 |
| 259 | GGGUCGCGAAAGGCCU | 16 | HCV.R1A-259<br>AmB.Rz-10/5 | aggccuuucg GgaggaaacucC CU UCAAGGACAUCGUCCGGG gaccc B | 54 |
| 266 | GAAAGGCCUUGUGGUA | 17 | HCV.R1A-266<br>AmB.Rz-10/5 | uaccacaagg GgaggaaacucC CU UCAAGGACAUCGUCCGGG cuuuc B | 55 |
| 273 | CUUGUGGUACUGCCUG | 18 | HCV.R1A-273<br>AmB.Rz-10/5 | caggcaguac GgaggaaacucC CU UCAAGGACAUCGUCCGGG acaag B | 56 |
| 288 | GAUAGGGUGCUUGCGA | 19 | HCV.R1A-288<br>AmB.Rz-10/5 | ucgcaagcac GgaggaaacucC CU UCAAGGACAUCGUCCGGG cuauc B | 57 |
| 291 | AGGGUGCUUGCGAGUG | 20 | HCV.R1A-291<br>AmB.Rz-10/5 | cacucgcaag GgaggaaacucC CU UCAAGGACAUCGUCCGGG acccu B | 58 |
| 7 | UGGGGGCGACACUCCA | 21 | HCV.R1A-7<br>AmB.Rz-10/5 | uggagugucg GgaggaaacucC CU UCAAGGACAUCGUCCGGG cccca B | 59 |
| 119 | CUCCCGGGAGAGCCAU | 22 | HCV.R1A-119<br>AmB.Rz-10/5 | auggcucucc GgaggaaacucC CU UCAAGGACAUCGUCCGGG gggag B | 60 |
| 120 | UCCCGGGAGAGCCAUA | 23 | HCV.R1A-120<br>AmB.Rz-10/5 | uauggcucuc GgaggaaacucC CU UCAAGGACAUCGUCCGGG cggga B | 61 |
| 133 | AUAGUGGUCUGCGGAA | 24 | HCV.R1A-133<br>AmB.Rz-10/5 | uuccgcagac GgaggaaacucC CU UCAAGGACAUCGUCCGGG acuau B | 62 |
| 140 | UCUGCGGAACCGGUGA | 25 | HCV.R1A-140<br>AmB.Rz-10/5 | ucaccgguuc GgaggaaacucC CU UCAAGGACAUCGUCCGGG gcaga B | 63 |
| 188 | UUCUUGGAUAACCCCG | 26 | HCV.R1A-188<br>AmB.Rz-10/5 | cgggguuauc GgaggaaacucC CU UCAAGGACAUCGUCCGGG aagaa B | 64 |
| 198 | ACCCCGCUCAAUGCCU | 27 | HCV.R1A-198<br>AmB.Rz-10/5 | aggcauugag GgaggaaacucC CU UCAAGGACAUCGUCCGGG ggggu B | 65 |
| 205 | UCAAUGCCUGGAGAUU | 28 | HCV.R1A-205<br>AmB.Rz-10/5 | aaucuccagg GgaggaaacucC CU UCAAGGACAUCGUCCGGG auuga B | 66 |
| 217 | GAUUUGGGCGUGCCCC | 29 | HCV.R1A-217<br>AmB.Rz-10/5 | ggggcacgcc GgaggaaacucC CU UCAAGGACAUCGUCCGGG aaauc B | 67 |
| 218 | AUUUGGGCGUGCCCCC | 30 | HCV.R1A-218<br>AmB.Rz-10/5 | gggggcacgc GgaggaaacucC CU UCAAGGACAUCGUCCGGG caaau B | 68 |
| 219 | UUUGGGCGUGCCCCCG | 31 | HCV.R1A-219<br>AmB.Rz-10/5 | cgggggcacg GgaggaaacucC CU UCAAGGACAUCGUCCGGG ccaaa B | 69 |
| 223 | GGCGUGCCCCCGCAAG | 32 | HCV.R1A-223<br>AmB.Rz-10/5 | cuugcggggg GgaggaaacucC CU UCAAGGACAUCGUCCGGG acgcc B | 70 |
| 229 | CCCCCGCAAGACUGCU | 33 | HCV.R1A-229<br>AmB.Rz-10/5 | agcagucuug GgaggaaacucC CU UCAAGGACAUCGUCCGGG ggggg B | 71 |
| 279 | GUACUGCCUGAUAGGG | 34 | HCV.R1A-279<br>AmB.Rz-10/5 | cccuaucagg GgaggaaacucC CU UCAAGGACAUCGUCCGGG aguac B | 72 |
| 295 | UGCUUGCGAGUGCCCC | 35 | HCV.R1A-295<br>AmB.Rz-10/5 | ggggcacucg GgaggaaacucC CU UCAAGGACAUCGUCCGGG aagca B | 73 |
| 301 | CGAGUGCCCCGGGAGG | 36 | HCV.R1A-301<br>AmB.Rz-10/5 | ccucccgggg GgaggaaacucC CU UCAAGGACAUCGUCCGGG acucg B | 74 |
| 306 | GCCCCGGGAGGUCUCG | 37 | HCV.R1A-306<br>AmB.Rz-10/5 | cgagaccucc GgaggaaacucC CU UCAAGGACAUCGUCCGGG ggggc B | 75 |
| 307 | CCCCGGGAGGUCUCGU | 38 | HCV.R1A-307<br>AmB.Rz-10/5 | acgagaccuc GgaggaaacucC CU UCAAGGACAUCGUCCGGG cgggg B | 76 |
| No<br>Ribo | | | | GgaaaggugugcaaccggagucaucauaauggcuucCCUUCaaggaCaUCgCCg<br>ggacggcB | 77 |
| Ribo | | | | GGAAAGGUGUGCAACCGGAGUCAUCAUAAUGGCUCCCUUCAAGGACAUCGUCCG<br>GGACGGCB | 78 | lower case = 2'-O-methyl
U, C = 2'-deoxy-2'-amino U, = 2'-deoxy-2'-amino C
G, A = ribo G, A
B = inverted deoxyabasic

TABLE XIV

Additional Class II enzymatic nucleic acid Motifs

| Class II Motif ID | Sequence | Seq ID No. | Kinetic Rate |
|---|---|---|---|
| A2 | GGGAGGAGGAAGUGCCUGGUCAGUCACACCGAGACUGGCAGACGCUGAAACC GCCGCGCUCGCUCCCAGUCC | 79 | UNK |
| A12 | GGGAGGAGGAAGUGCCUGGUAGUAAUAUAAUCGUUACUACGAGUGCAAGGUC GCCGCGCUCGCUCCCAGUCC | 80 | UNK |
| A11 | GGGAGGAGGAAGUGCCUGGUAGUUGCCCGAACUGUGACUACGAGUGAGGUC GCCGCGCUCGCUCCCAGUCC | 81 | UNK |
| B14 | GGGAGGAGGAAGUGCCUGGCGAUCAGAUGAGAUGAUGGCAGACGCAGAGACC GCCGCGCUCGCUCCCAGUCC | 82 | UNK |
| B10 | GGGAGGAGGAAGUGCCUGGCGACUGAUACGAAAAGUCGCAGUUUCGAAACC GCCGCGCUCGCUCCCAGUCC | 83 | UNK |
| B21 | GGGAGGAGGAAGUGCCUGGCGACUGAUACGAAAAGUCGCAGGUUUCGAAACC GCCGCGCUCGCUCCCAGUCC | 84 | UNK |
| B7 | GGGAGGAGGAAGUGCCUUGGCUCAGCAUAAGUGAGCAGAUUGCGACACC GCCGCGCUCGCUCCCAGUCC | 85 | UNK |
| C8 | GGGAGGAGGAAGUGCCUUGGUCAUUAGGAUGACAAACGUAUACUGAACACU GCCGCGCUCGCUCCCAGUCC | 86 | 0.01 MIN$^{-1}$ |

TABLE XV

Human Her2 Class II Ribozyme and Target Sequence

| RPI# | NT Pos | Substrate | Seq ID# | Ribozyme Alias | Ribozyme Sequence | Seq ID # |
|---|---|---|---|---|---|---|
| 18722 | 180 | CAUGGA G CUGGCG | 87 | erbB2-180 Zin.Rz-6 amino stab1 | $c_s g_s c_s c_s$ag GccgaaagG$C$GaGucaaGGu$C$u uccaug B | 196 |
| 18835 | 184 | GAGCUG G CGGCCU | 88 | erbB2-184 Zin.Rz-6 amino stab1 | $a_s g_s g_s c_s$cg GccgaaagG$C$GaGucaaGGu$C$u cagcuc B | 197 |
| 18828 | 276 | AGCUGCG G CUCCCUG | 89 | erbB2-276 Zin.Rz-7 amino stab1 | $c_s a_s g_s g_s$gag GccgaaagG$C$GaGucaaGGu$C$u cgcagcu B | 198 |
| 18653 | 314 | UGCUCC G CCACCU | 90 | erbB2-314 Zin.Rz-6 amino stab1 | $a_s g_s g_s u_s$gg GccgaaagG$C$GaGucaaGGu$C$u ggagca B | 199 |
| 18825 | 314 | AUGCUCC G CCACCUC | 91 | erbB2-314 Zin.Rz-7 amino stab1 | $g_s a_s g_s g_s$ugg GccgaaagGcGaGucaaGGu$C$u ggagcau B | 200 |
| 18831 | 379 | ACCAAU G CCAGCC | 92 | erbB2-379 Zin.Rz-6 amino stab1 | $g_s g_s c_s u_s$gg GccgaaagG$C$GaGucaaGGu$C$u auuggu B | 201 |
| 18680 | 433 | GCUCAUC G CUCACAA | 93 | erbB2-433 Zin.Rz-7 amino stab1 | $u_s u_s g_s u_s$gag GccgaaagG$C$GaGucaaGGu$C$u gaugagc B | 202 |
| 18711 | 594 | GGAGCU G CAGCUU | 94 | erbB2-594 Zin.Rz-6 amino stab1 | $a_s a_s g_s c_s$ug GccgaaagG$C$GaGucaaGGu$C$u agcucc B | 203 |
| 18681 | 594 | GGGAGCU G CAGCUUC | 95 | erbB2-594 Zin.Rz-7 amino stab1 | $g_s a_s a_s g_s$cug GccgaaagG$C$GaGucaaGGu$C$u agcuccc B | 204 |
| 18697 | 597 | GCUGCA G CUUCGA | 96 | erbB2-597 Zin.Rz-6 amino stab1 | $u_s c_s g_s a_s$ag GccgaaagG$C$GaGucaaGGu$C$u ugcagc B | 205 |
| 18665 | 597 | AGCUGCA G CUUCGAA | 97 | erbB2-597 Zin.Rz-7 amino stab1 | $u_s u_s c_s g_s$aag GccgaaagG$C$GaGucaaGGu$C$u ugcagcu B | 206 |
| 18712 | 659 | AGCUCU G CUACCA | 98 | erbB2-659 Zin.Rz-6 amino stab1 | $u_s g_s g_s u_s$ag GccgaaagG$C$GaGucaaGGu$C$u agagcu B | 207 |
| 18682 | 659 | CAGCUCU G CUACCAG | 99 | erbB2-659 Zin.Rz-7 amino stab1 | $c_s u_s g_s g_s$uag GccgaaagG$C$GaGucaaGGu$C$u agagcug B | 208 |
| 18683 | 878 | CUGACU G CUGCCA | 100 | erbB2-878 Zin.Rz-6 amino stab1 | $u_s g_s g_s c_s$ag GccgaaagG$C$GaGucaaGGu$C$u agucag B | 209 |
| 18654 | 878 | ACUGACU G CUGCCAU | 101 | erbB2-878 Zin.Rz-7 amino stab1 | $a_s u_s g_s g_s$cag GccgaaagG$C$GaGucaaGGu$C$u agucagu B | 210 |
| 18685 | 881 | ACUGCU G CCAUGA | 102 | erbB2-881 Zin.Rz-6 amino stab1 | $u_s c_s a_s u_s$gg GccgaaagG$C$GaGucaaGGu$C$u agcagu B | 211 |
| 18684 | 881 | GACUGCU G CCAUGAG | 103 | erbB2-881 Zin.Rz-7 amino stab1 | $c_s u_s c_s a_s$ugg GccgaaagG$C$GaGucaaGGu$C$u agcaguc B | 212 |
| 18723 | 888 | GCCAUGA G CAGUGUG | 104 | erbB2-888 Zin.Rz-7 amino stab1 | $c_s a_s c_s a_s$cug GccgaaagG$C$GaGucaaGGu$C$u ucauggc B | 213 |
| 18686 | 929 | CUGACU G CCUGGC | 105 | erbB2-929 Zin.Rz-6 amino stab1 | $g_s c_s c_s a_s$gg GccgaaagG$C$GaGucaaGGu$C$u agucag B | 214 |
| 18648 | 929 | UCUGACU G CCUGGCC | 106 | erbB2-929 Zin.Rz-7 amino stab1 | $g_s g_s c_s c_s$agg GccgaaagG$C$GaGucaaGGu$C$u agucaga B | 215 |
| 18666 | 934 | UGCCUG G CCUGCC | 107 | erbB2-934 Zin.Rz-6 amino stab1 | $g_s g_s c_s a_s$gg GccgaaagG$C$GaGucaaGGu$C$u caggca B | 216 |
| 18651 | 934 | CUGCCUG G CCUGCCU | 108 | erbB2-934 Zin.Rz-7 amino stab1 | $a_s g_s g_s c_s$agg GccgaaagG$C$GaGucaaGGu$C$u caggcag B | 217 |
| 18655 | 938 | UGGCCU G CCUCCA | 109 | erbB2-938 Zin.Rz-6 amino stab1 | $u_s g_s g_s a_s$gg GccgaaagG$C$GaGucaaGGu$C$u aggcca B | 218 |
| 18649 | 938 | CUGGCCU G CCUCCAC | 110 | erbB2-938 Zin.Rz-7 amino stab1 | $g_s u_s g_s g_s$agg GccgaaagG$C$GaGucaaGGu$C$u aggccag B | 219 |
| 18667 | 969 | CUGUGA G CUGCAC | 111 | erbB2-969 Zin.Rz-6 amino stab1 | $g_s u_s g_s c_s$ag GccgaaagG$C$GaGucaaGGu$C$u ucacag B | 220 |
| 18668 | 969 | UCUGUGA G CUGCACU | 112 | erbB2-969 Zin.Rz-7 amino stab1 | $a_s g_s u_s g_s$cag GccgaaagG$C$GaGucaaGGu$C$u ucacaga B | 221 |

TABLE XV-continued

Human Her2 Class II Ribozyme and Target Sequence

| RPI# | NT Pos | Substrate | Seq ID# | Ribozyme Alias | Ribozyme Sequence | Seq ID# |
|---|---|---|---|---|---|---|
| 18656 | 972 | UGAGCU G CACUGC | 113 | erbB2-972 Zin.Rz-6 amino stab1 | $g_sc_sa_sg_s$ug Gccgaaag G$\underline{C}$GaGucaaGGu$\underline{C}$u agcuca B | 222 |
| 18657 | 972 | GUGAGCU G CACUGCC | 114 | erbB2-972 Zin.Rz-7 amino stab1 | $g_sg_sc_sa_s$gug Gccgaaag G$\underline{C}$GaGucaaGGu$\underline{C}$u agcucac B | 223 |
| 19294 | 972 |  |  | erbB2-972 Zin.Rz-6 amino stab1 | $g_sc_sa_sg_s$ug GccaauuuguG G$\underline{C}$GaGucaaGGu$\underline{C}$u agcuca B | 224 |
| 19295 | 972 |  |  | erbB2-972 Zin.Rz-6 amino stab1 | $g_sc_sa_sg_s$ug GccAAuuuGuGG$\underline{C}$GaGucaaGGu$\underline{C}$u agcuca B | 225 |
| 19293 | 972 |  |  | erbB2-972 Zin.Rz-6 amino stab1 | $g_sc_sa_sg_s$ug gccgaaag g$\underline{C}$gagugaGGu$\underline{C}$u agcuca B | 226 |
| 19292 | 972 |  |  | erbB2-972 Zin.Rz-6 amino stab1 | $g_sc_sa_sg_s$ug Gccgaaag G$\underline{C}$GaGuGaGGu$\underline{C}$u agcuca B | 227 |
| 19296 | 972 |  |  | erbB2-972 Zin.Rz-6 amino stab1 | $g_sc_sa_sg_s$ug GccacAAuuuGuGGcag G$\underline{C}$GaGucaaGGu$\underline{C}$u agcuca B | 228 |
| 19727 | 972 |  |  | erbB2-972 Zin.Rz-6 amino stab1 | $g_sc_sa_sg_s$ug gccgaaag g$\underline{C}$gagugaggu$\underline{C}$u agcuca B | 229 |
| 19728 | 972 |  |  | erbB2-972 Zin.Rz-6 amino stab1 | $g_sc_sa_sg_s$ug gccgaaag g$\underline{C}$gagugagGu$\underline{C}$u agcuca B | 230 |
| 18659 | 1199 | GAGUGU G CUAUGG | 115 | erbB2-1199 Zin.Rz-6 amino stab1 | $c_sc_sa_su_s$ag Gccgaaag G$\underline{C}$GaGucaaGGu$\underline{C}$u acacuc B | 231 |
| 18658 | 1199 | CGAGUGU G CUAUGGU | 116 | erbB2-1199 Zin.Rz-7 amino stab1 | $a_sc_sc_sa_s$uag Gccgaaag G$\underline{C}$GaGucaaGGu$\underline{C}$u acacucg B | 232 |
| 18724 | 1205 | GCUAUG G UCUGGG | 117 | erbB2-1205 Zin.Rz-6 amino stab1 | $c_sc_sc_sa_s$ga Gccgaaag G$\underline{C}$GaGucaaGGu$\underline{C}$u cauagc B | 233 |
| 18669 | 1205 | UGCUAUG G UCUGGGC | 118 | erbB2-1205 Zin.Rz-7 amino stab1 | $g_sc_sc_sc_s$aga Gccgaaag G$\underline{C}$GaGucaaGGu$\underline{C}$u cauagca B | 234 |
| 18725 | 1211 | GUCUGG G CAUGGA | 119 | erbB2-1211 Zin.Rz-6 amino stab1 | $u_sc_sc_sa_s$ug Gccgaaag G$\underline{C}$GaGucaaGGu$\underline{C}$u ccagac B | 235 |
| 18726 | 1292 | UUGGGA G CCUGGC | 120 | erbB2-1292 Zin.Rz-6 amino stab1 | $g_sc_sc_sa_s$gg Gccgaaag G$\underline{C}$GaGucaaGGu$\underline{C}$u ucccaa B | 236 |
| 18698 | 1292 | UUUGGGA G CCUGGCA | 121 | erbB2-1292 Zin.Rz-7 amino stab1 | $u_sg_sc_sc_s$agg Gccgaaag G$\underline{C}$GaGucaaGGu$\underline{C}$u ucccaaa B | 237 |
| 18727 | 1313 | CCGGAGA G CUUUGAU | 122 | erbB2-1313 Zin.Rz-7 amino stab1 | $a_su_sc_sa_s$aag Gccgaaag G$\underline{C}$GaGucaaGGu$\underline{C}$u ucuccgg B | 238 |
| 18699 | 1397 | UCACAG G UUACCU | 123 | erbB2-1397 Zin.Rz-6 amino stab1 | $a_sg_sg_su_s$aa Gccgaaag G$\underline{C}$GaGucaaGGu$\underline{C}$u cuguga B | 239 |
| 18728 | 1414 | AUCUCA G CAUGGC | 124 | erbB2-1414 Zin.Rz-6 amino stab1 | $g_sc_sc_sa_s$ug Gccgaaag G$\underline{C}$GaGucaaGGu$\underline{C}$u ugagau B | 240 |
| 18670 | 1414 | CAUCUCA G CAUGGCC | 125 | erbB2-1414 Zin.Rz-7 amino stab1 | $g_sg_sc_sc_s$aug Gccgaaag G$\underline{C}$GaGucaaGGu$\underline{C}$u ugagaug B | 241 |
| 18671 | 1536 | GCUGGG G CUGCGC | 126 | erbB2-1536 Zin.Rz-6 amino stab1 | $g_sc_sg_sc_s$ag Gccgaaag G$\underline{C}$GaGucaaGGu$\underline{C}$u cccagc B | 242 |
| 18687 | 1541 | GGCUGC G CUCACU | 127 | erbB2-1541 Zin.Rz-6 amino stab1 | $a_sg_su_sg_s$ag Gccgaaag G$\underline{C}$GaGucaaGGu$\underline{C}$u gcagcc B | 243 |
| 18829 | 1562 | CUGGGCA G UGGACUG | 128 | erbB2-1562 Zin.Rz-7 amino stab1 | $c_sa_sg_su_s$cca Gccgaaag G$\underline{C}$GaGucaaGGu$\underline{C}$u ugcccag B | 244 |
| 18830 | 1626 | GGGACCA G CUCUUUC | 129 | erbB2-1626 Zin.Rz-7 amino stab1 | $g_sa_sa_sa_s$gag Gccgaaag G$\underline{C}$GaGucaaGGu$\underline{C}$u uguccc B | 245 |
| 18700 | 1755 | CACCCA G UGUGUC | 130 | erbB2-1755 Zin.Rz-6 amino stab1 | $g_sa_sc_sa_s$ca Gccgaaag G$\underline{C}$GaGucaaGGu$\underline{C}$u ugggug B | 246 |
| 18672 | 1755 | CCACCCA G UGUGUCA | 131 | erbB2-1755 Zin.Rz-7 amino stab1 | $u_sg_sa_sc_s$aca Gccgaaag G$\underline{C}$GaGucaaGGu$\underline{C}$u ugggugg B | 247 |
| 18688 | 1757 | CCCAGU G UGUCAA | 132 | erbB2-1757 Zin.Rz-6 amino stab1 | $u_su_sg_sa_s$ca Gccgaaag G$\underline{C}$GaGucaaGGu$\underline{C}$u acuggg B | 248 |
| 18660 | 1757 | ACCCAGU G UGUCAAC | 133 | erbB2-1757 Zin.Rz-7 amino stab1 | $g_su_su_sg_s$aca Gccgaaag G$\underline{C}$GaGucaaGGu$\underline{C}$u acugggu B | 249 |
| 18689 | 1759 | CAGUGU G UCAACU | 134 | erbB2-1759 Zin.Rz-6 amino stab1 | $a_sg_su_su_s$ga Gccgaaag G$\underline{C}$GaGucaaGGu$\underline{C}$u acacug B | 250 |
| 18690 | 1759 | CCAGUGU G UCAACUG | 135 | erbB2-1759 Zin.Rz-7 amino stab1 | $c_sa_sg_su_s$uga Gccgaaag G$\underline{C}$GaGucaaGGu$\underline{C}$u acacugg B | 251 |
| 18701 | 1784 | UUCGGG G CCAGGA | 136 | erbB2-1784 Zin.Rz-6 amino stab1 | $u_sc_sc_su_s$gg Gccgaaag G$\underline{C}$GaGucaaGGu$\underline{C}$u cccgaa B | 252 |
| 18673 | 1784 | CUUCGGG G CCAGGAG | 137 | erbB2-1784 Zin.Rz-7 amino stab1 | $c_su_sc_sc_s$ugg Gccgaaag G$\underline{C}$GaGucaaGGu$\underline{C}$u cccgaag B | 253 |
| 18691 | 2063 | UCAACU G CACCCA | 138 | erbB2-2063 Zin.Rz-6 amino stab1 | $u_sg_sg_sg_s$ug Gccgaaag G$\underline{C}$GaGucaaGGu$\underline{C}$u aguuga B | 254 |
| 18661 | 2063 | AUCAACU G CACCCAC | 139 | erbB2-2063 Zin.Rz-7 amino stab1 | $g_su_sg_sg_s$gug Gccgaaag G$\underline{C}$GaGucaaGGu$\underline{C}$u aguugau B | 255 |
| 18692 | 2075 | ACUCCU G UGUGGA | 140 | erbB2-2075 Zin.Rz-6 amino stab1 | $u_sc_sc_sa_s$ca Gccgaaag G$\underline{C}$GaGucaaGGu$\underline{C}$u aggagu B | 256 |
| 18729 | 2116 | CAGAGA G CCAGCC | 141 | erbB2-2116 Zin.Rz-6 amino stab1 | $g_sg_sc_su_s$gg Gccgaaag G$\underline{C}$GaGucaaGGu$\underline{C}$u ucucug B | 257 |

TABLE XV-continued

Human Her2 Class II Ribozyme and Target Sequence

| RPI# | NT Pos | Substrate | Seq ID# | Ribozyme Alias | Ribozyme Sequence | | Seq ID # |
|---|---|---|---|---|---|---|---|
| 18832 | 2247 | GACUGCU G CAGGAAA | 142 | erbB2-2247 Zin.Rz-7 amino stab1 | $u_s u_s u_s c_s$ctg GccgaaagGCGaGucaaGGuCu agcaguc | B | 258 |
| 18833 | 2271 | UGGAGCC G CUGACAC | 143 | erbB2-2271 Zin.Rz-7 amino stab1 | $g_s u_s g_s u_s$cag GccgaaagGCGaGucaaGGuCu ggcucca | B | 259 |
| 18702 | 2341 | AGGAAG G UGAAGG | 144 | erbB2-2341 Zin.Rz-6 amino stab1 | $c_s c_s u_s u_s$ca GccgaaagGCGaGucaaGGuCu cuuccu | B | 260 |
| 18730 | 2347 | GUGAAG G UGCUUG | 145 | erbB2-2347 Zin.Rz-6 amino stab1 | $c_s a_s a_s g_s$ca GccgaaagGCGaGucaaGGuCu cuucac | B | 261 |
| 18674 | 2347 | GGUGAAG G UGCUUGG | 146 | erbB2-2347 Zin.Rz-7 amino stab1 | $c_s c_s a_s a_s$gca GccgaaagGCGaGucaaGGuCu cuucacc | B | 262 |
| 18713 | 2349 | GAAGGU G CUUGA | 147 | erbB2-2349 Zin.Rz-6 amino stab1 | $u_s c_s c_s a_s$ag GccgaaagGCGaGucaaGGuCu accuuc | B | 263 |
| 18693 | 2349 | UGAAGGU G CUUGGAU | 148 | erbB2-2349 Zin.Rz-7 amino stab1 | $a_s u_s c_s c_s$aag GccgaaagGCGaGucaaGGuCu accuuca | B | 264 |
| 18731 | 2384 | UACAAGG G CAUCUGG | 149 | erbB2-2384 Zin.Rz-7 amino stab1 | $c_s c_s a_s g_s$aug GccgaaagGCGaGucaaGGuCu ccuugua | B | 265 |
| 18714 | 2410 | GGAGAAU G UGAAAAU | 150 | erbB2-2410 Zin.Rz-7 amino stab1 | $a_s u_s u_s u_s$uca GccgaaagGCGaGucaaGGuCu auucucc | B | 266 |
| 18732 | 2497 | GUGAUG G CUGGUG | 151 | erbB2-2497 Zin.Rz-6 amino stab1 | $c_s a_s c_s c_s$ag GccgaaagGCGaGucaaGGuCu caucac | B | 267 |
| 18703 | 2501 | UGGCUG G UGUGGG | 152 | erbB2-2501 Zin.Rz-6 amino stab1 | $c_s c_s c_s a_s$ca GccgaaagGCGaGucaaGGuCu cagcca | B | 268 |
| 18715 | 2540 | GCAUCU G CCUGAC | 153 | erbB2-2540 Zin.Rz-6 amino stab1 | $g_s u_s c_s a_s$gg GccgaaagGCGaGucaaGGuCu agaugc | B | 269 |
| 18733 | 2563 | CAGCUG G UGACAC | 154 | erbB2-2563 Zin.Rz-6 amino stab1 | $g_s u_s g_s u_s$ca GccgaaagGCGaGucaaGGuCu cagcug | B | 270 |
| 18734 | 2571 | GACACA G CUUAUG | 155 | erbB2-2571 Zin.Rz-6 amino stab1 | $c_s a_s u_s a_s$ag GccgaaagGCGaGucaaGGuCu uguguc | B | 271 |
| 18675 | 2571 | UGACACA G CUUAUGC | 156 | erbB2-2571 Zin.Rz-7 amino stab1 | $g_s c_s a_s u_s$aag GccgaaagGCGaGucaaGGuCu uguguca | B | 272 |
| 18716 | 2662 | CAGAUU G CCAAGG | 157 | erbB2-2662 Zin.Rz-6 amino stab1 | $c_s c_s u_s u_s$gg GccgaaagGCGaGucaaGGuCu aaucug | B | 273 |
| 18704 | 2675 | GGAUGA G CUACCU | 158 | erbB2-2675 Zin.Rz-6 amino stab1 | $a_s g_s g_s u_s$ag GccgaaagGCGaGucaaGGuCu ucaucc | B | 274 |
| 18676 | 2675 | GGGAUGA G CUACCUG | 159 | erbB2-2675 Zin.Rz-7 amino stab1 | $c_s a_s g_s g_s$uag GccgaaagGCGaGucaaGGuCu ucaucc | B | 275 |
| 18735 | 2738 | GUCAAGA G UCCCAAC | 160 | erbB2-2738 Zin.Rz-7 amino stab1 | $g_s u_s u_s g_s$gga GccgaaagGCGaGucaaGGuCu ucuugac | B | 276 |
| 18705 | 2773 | GGGCUG G CUCGGC | 161 | erbB2-2773 Zin.Rz-6 amino stab1 | $g_s c_s c_s g_s$ag GccgaaagGCGaGucaaGGuCu cagccc | B | 277 |
| 18836 | 2778 | UGGCUCG G CUGCUGG | 162 | erbB2-2778 Zin.Rz-7 amino stab1 | $c_s c_s a_s g_s$cag GccgaaagGCGaGucaaGGuCu cgagcca | B | 278 |
| 18694 | 2781 | UCGGCU G CUGGAC | 163 | erbB2-2781 Zin.Rz-6 amino stab1 | $g_s u_s c_s c_s$ag GccgaaagGCGaGucaaGGuCu agccga | B | 279 |
| 18662 | 2781 | CUCGGCU G CUGGACA | 164 | erbB2-2781 Zin.Rz-7 amino stab1 | $u_s g_s u_s c_s$cag GccgaaagGCGaGucaaGGuCu agccgag | B | 280 |
| 18737 | 2802 | GACAGA G UACCAU | 165 | erbB2-2802 Zin.Rz-6 amino stab1 | $a_s u_s g_s g_s$ua GccgaaagGCGaGucaaGGuCu ucuguc | B | 281 |
| 18736 | 2802 | AGACAGA G UACCAUG | 166 | erbB2-2802 Zin.Rz-7 amino stab1 | $c_s a_s u_s g_s$gua GccgaaagGCGaGucaaGGuCu ucugucu | B | 282 |
| 18717 | 2809 | GUACCAU G CAGAUGG | 167 | erbB2-2809 Zin.Rz-7 amino stab1 | $c_s c_s a_s u_s$cug GccgaaagGCGaGucaaGGuCu augguac | B | 283 |
| 18738 | 2819 | AUGGGG G CAAGGU | 168 | erbB2-2819 Zin.Rz-6 amino stab1 | $a_s c_s c_s u_s$ug GccgaaagGCGaGucaaGGuCu ccccau | B | 284 |
| 18706 | 2819 | GAUGGGG G CAAGGUG | 169 | erbB2-2819 Zin.Rz-7 amino stab1 | $c_s a_s c_s c_s$uug GccgaaagGCGaGucaaGGuCu ccccauc | B | 285 |
| 18695 | 2887 | GAGUGAU G UGUGGAG | 170 | erbB2-2887 Zin.Rz-7 amino stab1 | $c_s u_s c_s c_s$aca GccgaaagGCGaGucaaGGuCu aucacuc | B | 286 |
| 18663 | 2908 | GUGACU G UGUGGG | 171 | erbB2-2908 Zin.Rz-6 amino stab1 | $c_s c_s c_s a_s$ca GccgaaagGCGaGucaaGGuCu agucac | B | 287 |
| 18826 | 2908 | UGUGACU G UGUGGGA | 172 | erbB2-2908 Zin.Rz-7 amino stab1 | $u_s c_s c_s c_s$aca GccgaaagGCGaGucaaGGuCu agucaca | B | 288 |
| 18664 | 2910 | GACUGU G UGGGAG | 173 | erbB2-2910 Zin.Rz-6 amino stab1 | $c_s u_s c_s c_s$ca GccgaaagGCGaGucaaGGuCu acaguc | B | 289 |
| 18650 | 2910 | UGACUGU G UGGGAGC | 174 | erbB2-2910 Zin.Rz-7 amino stab1 | $g_s c_s u_s c_s$cca GccgaaagGCGaGucaaGGuCu acaguca | B | 290 |
| 18677 | 2916 | GUGGGA G CUGAUG | 175 | erbB2-2916 Zin.Rz-6 amino stab1 | $c_s a_s u_s c_s$ag GccgaaagGCGaGucaaGGuCu ucccac | B | 291 |
| 18652 | 2916 | UGUGGGA G CUGAUGA | 176 | erbB2-2916 Zin.Rz-7 amino stab1 | $u_s c_s a_s u_s$cag GccgaaagGCGaGucaaGGuCu ucccaca | B | 292 |
| 18707 | 2932 | UUUGGG G CCAAAC | 177 | erbB2-2932 Zin.Rz-6 amino stab1 | $g_s u_s u_s u_s$gg GccgaaagGCGaGucaaGGuCu cccaaa | B | 293 |

TABLE XV-continued

Human Her2 Class II Ribozyme and Target Sequence

| RPI# | NT Pos | Substrate | Seq ID# | Ribozyme Alias | Ribozyme Sequence | Seq ID # |
|---|---|---|---|---|---|---|
| 18678 | 2932 | UUUUGGG G CCAAACC | 178 | erbB2-2932 Zin.Rz-7 amino stab1 | $g_s g_s u_s u_s$ugg GccgaaagGCGaGucaaGGuCu cccaaaa B | 294 |
| 18719 | 3025 | AUUGAU G UCUACA | 179 | erbB2-3025 Zin.Rz-6 amino stab1 | $u_s g_s u_s a_s$ga GccgaaagGCGaGucaaGGuCu aucaau B | 295 |
| 18718 | 3025 | CAUUGAU G UCUACAU | 180 | erbB2-3025 Zin.Rz-7 amino stab1 | $a_s u_s g_s u_s$aga GccgaaagGCGaGucaaGGuCU aucaaug B | 296 |
| 18720 | 3047 | UCAAAU G UUGGAU | 181 | erbB2-3047 Zin.Rz-6 amino stab1 | $a_s u_s c_s c_s$aa GccgaaagGCGaGucaaGGuCu auuuga B | 297 |
| 18696 | 3047 | GUCAAAU G UUGGAUG | 182 | erbB2-3047 Zin.Rz-7 amino stab1 | $c_s a_s u_s c_s$caa GccgaaagGCGaGucaaGGuCu auuugac B | 298 |
| 18739 | 3087 | CCGGGA G UUGGUG | 183 | erbB2-3087 Zin.Rz-6 amino stab1 | $c_s a_s c_s c_s$aa GccgaaagGCGaGucaaGGuCu ucccgg B | 299 |
| 18708 | 3087 | UCCGGGA G UUGGUGU | 184 | erbB2-3087 Zin.Rz-7 amino stab1 | $a_s c_s a_s c_s$caa GccgaaagGCGaGucaaGGuCu ucccgga B | 300 |
| 18740 | 3415 | GAAGGG G CUGGCU | 185 | erbB2-3415 Zin.Rz-6 amino stab1 | $a_s g_s c_s c_s$ag GccgaaagGCGaGucaaGGuCu cccuuc B | 301 |
| 18741 | 3419 | GGGCUG G CUCCGA | 186 | erbB2-3419 Zin.Rz-6 amino stab1 | $u_s c_s g_s g_s$ag GccgaaagGCGaGucaaGGuCu cagccc B | 302 |
| 18837 | 3419 | GGGGCUG G CUCCGAU | 187 | erbB2-3419 Zin.Rz-7 amino stab1 | $a_s u_s c_s g_s$gag GccgaaagGCGaGucaaGGuCu cagcccc B | 303 |
| 18709 | 3437 | UUGAUG G UGACCU | 188 | erbB2-3437 Zin.Rz-6 amino stab1 | $a_s g_s g_s u_s$ca GccgaaagGCGaGucaaGGuCu caucaa B | 304 |
| 18679 | 3437 | UUUGAUG G UGACCUG | 189 | erbB2-3437 Zin.Rz-7 amino stab1 | $c_s a_s g_s g_s$uca GccgaaagGCGaGucaaGGuCu caucaaa B | 305 |
| 18823 | 3504 | UCUACA G CGGUAC | 190 | erbB2-3504 Zin.Rz-6 amino stab1 | $g_s u_s a_s c_s$cg GccgaaagGCGaGucaaGGuCu uguaga B | 306 |
| 18710 | 3504 | CUCUACA G CGGUACA | 191 | erbB2-3504 Zin.Rz-7 amino stab1 | $u_s g_s u_s a_s$ccg GccgaaagGCGaGucaaGGuCu uguagag B | 307 |
| 18721 | 3724 | CAAAGAC G UUUUUGC | 192 | erbB2-3724 Zin.Rz-7 amino stab1 | $g_s c_s a_s a_s$aaa GccgaaagGCGaGucaaGGuCu gucuuug B | 308 |
| 18834 | 3808 | CCUCCU G CCUUCA | 193 | erbB2-3808 Zin.Rz-6 amino stab1 | $u_s g_s a_s a_s$gg GccgaaagGCGaGucaaGGuCu aggagg B | 309 |
| 18827 | 3808 | UCCUCCU G CCUUCAG | 194 | erbB2-3808 Zin.Rz-7 amino stab1 | $c_s u_s g_s a_s$agg GccgaaagGCGaGucaaGGuCu aggagga B | 310 |
| 18824 | 3996 | GGGAAG G CCUGAC | 195 | erbB2-3996 Zin.Rz-6 amino stab1 | $g_s u_s c_s a_s$gg GccgaaagGCGaGucaaGGuCu cuuccc B | 311 |

UPPER CASE = RIBO
Lower case = 2'-O-methyl
C = 2'-deoxy-2'-amino Cytidine
s = phosphorothioate
B = inverted deoxyabasic

TABLE XVI

Human HER2 Class II (zinzyme) Ribozyme and Target Sequence

| Pos | Substrate | Seq ID | Ribozyme | Rz Seq ID |
|---|---|---|---|---|
| 46 | GGGCAGCC G CGCGCCCC | 312 | GGGGCGCG GCCGAAAGGCGAGUCAAGGUCU GGCUGCCC | 897 |
| 48 | GCAGCCGC G CGCCCUU | 313 | AAGGGGCG GCCGAAAGGCGAGUCAAGGUCU GCGGCUGC | 898 |
| 50 | AGCCGCGC G CCCCUUCC | 314 | GGAAGGGG GCCGAAAGGCGAGUCAAGGUCU GCGCGGCU | 899 |
| 75 | CCUUUACU G CGCCGCGC | 315 | GCGCGGCG GCCGAAAGGCGAGUCAAGGUCU AGUAAAGG | 900 |
| 77 | UUUACUGC G CCGCGCGC | 316 | GCGCGCGG GCCGAAAGGCGAGUCAAGGUCU GCAGUAAA | 901 |
| 80 | ACUGCGCC G CGCGCCCG | 317 | CGGGCGCG GCCGAAAGGCGAGUCAAGGUCU GGCGCAGU | 902 |
| 82 | UGCGCCGC G CCCCGGC | 318 | GCCGGGCG GCCGAAAGGCGAGUCAAGGUCU GCGGCGCA | 903 |
| 84 | CGCCGCGC G CCCGGCCC | 319 | GGGCCGGG GCCGAAAGGCGAGUCAAGGUCU GCGCGGCG | 904 |
| 102 | CACCCCUC G CAGCACCC | 320 | GGGUGCUG GCCGAAAGGCGAGUCAAGGUCU GAGGGGUG | 905 |
| 112 | AGCACCCC G CGCCCCGC | 321 | GCGGGGCG GCCGAAAGGCGAGUCAAGGUCU GGGGUGCU | 906 |
| 114 | CACCCCGC G CCCCGCGC | 322 | GCGCGGGG GCCGAAAGGCGAGUCAAGGUCU GCGGGGUG | 907 |
| 119 | CGCGCCCC G CGCCCUCC | 323 | GGAGGGCG GCCGAAAGGCGAGUCAAGGUCU GGGGCGCG | 908 |
| 121 | CGCCCCGC G CCCUCCCA | 324 | UGGGAGGG GCCGAAAGGCGAGUCAAGQUCU GCGGGGCG | 909 |
| 163 | CCGGAGCC G CAGUGAGC | 325 | GCUCACUG GCCGAAAGGCGAGUCAAGGUCU GGCUCCGG | 910 |
| 194 | GGCCUUGU G CCGCUGGG | 326 | CCCAGCGG GCCGAAAGGCGAGUCAAGGUCU ACAAGGCC | 911 |
| 197 | CUUGUGCC G CUGGGGG | 327 | GCCCCCAG GCCGAAAGGCGAGUCAAGGUCU GGCACAAG | 912 |
| 214 | UCCUCCUC G CCCUCUUG | 328 | CAAGAGGG GCCGAAAGGCGAGUCAAGGUCU GAGGAGGA | 913 |
| 222 | GCCCUCUU G CCCCCCGG | 329 | CCGGGGGG GCCGAAAGGCGAGUCAAGGUCU AAGAGGGC | 914 |
| 235 | CCGGAGCC G CGAGCACC | 330 | GGUGCUCG GCCGAAAGGCGAGUCAAGGUCU GGCUCCGG | 915 |
| 251 | CCAAGUGU G CACCGGCA | 331 | UGCCGGUG GCCGAAAGGCGAGUCAAGGUCU ACACUUGG | 916 |
| 273 | AUGAGCU G CGGCUCCC | 332 | GGGAGCCG GCCGAAAGGCGAGUCAAGGUCU AGCUUCAU | 917 |

TABLE XVI-continued

Human HER2 Class II (zinzyme) Ribozyme and Target Sequence

| Pos | Substrate | | | Seq ID | Ribozyme | | Rz Seq ID |
|---|---|---|---|---|---|---|---|
| 283 | GGCUCCCU | G | CCAGUCCC | 333 | GGGACUGG GCCGAAAGGCGAGUCAAGGUCU AGGGAGCC | | 918 |
| 309 | CUGGACAU | G | CUCCGCCA | 334 | UGGCGGAG GCCGAAAGGCGAGUCAAGGUCU AUGUCCAG | | 919 |
| 314 | CAUGCUCC | G | CCACCUCU | 335 | AGAGGUGG GCCGAAAGGCGAGUCAAGGUCU GGAGCAUG | | 920 |
| 332 | CCAGGGCU | G | CCAGGUGG | 336 | CCACCUGG GCCGAAAGGCGAGUCAAGGUCU AGCCCUGG | | 921 |
| 342 | CAGGUGGU | G | CAGGGAAA | 337 | UUUCCCUG GCCGAAAGGCGAGUCAAGGUCU ACCACCUG | | 922 |
| 369 | ACCUACCU | G | CCCACCAA | 338 | UUGGUGGG GCCGAAAGGCGAGUCAAGGUCU AGGUAGGU | | 923 |
| 379 | CCACCAAU | G | CCAGCCUG | 339 | CAGGCUGG GCCGAAAGGCGAGUCAAGGUCU AUUGGUGG | | 924 |
| 396 | UCCUUCCU | G | CAGGAUAU | 340 | AUAUCCUG GCCGAAAGGCGAGUCAAGGUCU AGGAAGGA | | 925 |
| 414 | CAGGAGGU | G | CAGGGCUA | 341 | UAGCCCUG GCCGAAAGGCGAGUCAAGGUCU ACCUCCUG | | 926 |
| 426 | GGCUACGU | G | CUCAUCGC | 342 | GCGAUGAG GCCGAAAGGCGAGUCAAGGUCU ACGUAGCC | | 927 |
| 433 | UGCUCAUC | G | CUCACAAC | 343 | GUUGUGAG GCCGAAAGGCGAGUCAAGGUCU GAUGAGCA | | 928 |
| 462 | GUCCCACU | G | CAGAGGCU | 344 | AGCCUCUG GCCGAAAGGCGAGUCAAGGUCU AGUGGGAC | | 929 |
| 471 | CAGAGGCU | G | CGGAUUGU | 345 | ACAAUCCG GCCGAAAGGCGAGUCAAGGUCU AGCCUCUG | | 930 |
| 480 | CGGAUUGU | G | CAGGCAC | 346 | GUGCCUGC GCCGAAAGGCGAGUCAAGGUCU ACAAUCCG | | 931 |
| 511 | ACAACUAU | G | CCCUGGCC | 347 | GGCCAGGG GCCGAAAGGCGAGUCAAGGUCU AUAGUUGU | | 932 |
| 522 | CUGGCCGU | G | CUAGACAA | 348 | UUGUCUAG GCCGAAAGGCGAGUCAAGGUCU ACGGCCAG | | 933 |
| 540 | GGAGACCC | G | CUGAACAA | 349 | UUGUUCAG GCCGAAAGGCGAGUCAAGGUCU GGGUCUCC | | 934 |
| 585 | GGAGGCCU | G | CGGGAGCU | 350 | AGCUCCCG GCCGAAAGGCGAGUCAAGGUCU AGGCCUCC | | 935 |
| 594 | CGGGAGCU | G | CAGCUUCG | 351 | CGAAGCUG GCCGAAAGGCGAGUCAAGGUCU AGCUCCCG | | 936 |
| 659 | CCAGCUCU | G | CUACCAGG | 352 | CCUGGUAG GCCGAAAGGCGAGUCAAGGUCU AGAGCUGG | | 937 |
| 737 | CACCAACC | G | CUCUCGGG | 353 | CCCGAGAG GCCGAAAGGCGAGUCAAGGUCU GGUUGGUG | | 938 |
| 749 | UCGGGCCU | G | CCACCCCU | 354 | AGGGGUGG GCCGAAAGGCGAGUCAAGGUCU AGGCCCGA | | 939 |
| 782 | GGGCUCCC | G | CUGCUGGG | 355 | CCCAGCAG GCCGAAAGGCGAGUCAAGGUCU GGGAGCCC | | 940 |
| 785 | CUCCCGCU | G | CUGGGGAG | 356 | CUCCCCAG GCCGAAAGGCGAGUCAAGGUCU AGCGGGAG | | 941 |
| 822 | AGCCUGAC | G | CGCACUGU | 357 | ACAGUGCG GCCGAAAGGCGAGUCAAGGUCU GUCAGGCU | | 942 |
| 824 | CCUGACGC | G | CACUGUCU | 358 | AGACAGUG GCCGAAAGGCGAGUCAAGGUCU GCGUCAGG | | 943 |
| 835 | CUGUCUGU | G | CCGGUGGC | 359 | GCCACCGG GCCGAAAGGCGAGUCAAGGUCU ACAGACAG | | 944 |
| 847 | GUGGCUGU | G | CCCGCUGC | 360 | GCAGCGGG GCCGAAAGGCGAGUCAAGGUCU ACAGCCAC | | 945 |
| 851 | CUGUGCCC | G | CUGCAAGG | 361 | CCUUGCAG GCCGAAAGGCGAGUCAAGGUCU GGGCACAG | | 946 |
| 854 | UGCCCGCU | G | CAAGGGGC | 362 | GCCCCUUG GCCGAAAGGCGAGUCAAGGUCU AGCGGGCA | | 947 |
| 867 | GGGCCACU | G | CCCACUGA | 363 | UCAGUGGG GCCGAAAGGCGAGUCAAGGUCU AGUGGCCC | | 948 |
| 878 | CACUGACU | G | CUGCCAUG | 364 | CAUGGCAG GCCGAAAGGCGAGUCAAGGUCU AGUCAGUG | | 949 |
| 881 | UGACUGCU | G | CCAUGAGC | 365 | GCUCAUGG GCCGAAAGGCGAGUCAAGGUCU AGCAGUCA | | 950 |
| 895 | AGCAGUGU | G | CUGCCGGC | 366 | GCCGGCAG GCCGAAAGGCGAGUCAAGGUCU ACACUGCU | | 951 |
| 898 | AGUGUGCU | G | CCGGCCGG | 367 | GCCGGCCG GCCGAAAGGCGAGUCAAGGUCU AGCACACU | | 952 |
| 905 | UGCCGGCU | G | CACGGGCC | 368 | BGCCCGUG GCCGAAAGGCGAGUCAAGGUCU AGCCGGCA | | 953 |
| 929 | CUCUGACU | G | CCUGGCCU | 369 | AGGCCAGG GCCGAAAGGCGAGUCAAGGUCU AGUCAGAG | | 954 |
| 938 | CCUGGCCU | G | CCUCCACU | 370 | AGUGGAGG GCCGAAAGGCGAGUCAAGGUCU AGGCCAGG | | 955 |
| 972 | UGUGAGCU | G | CACUGCCC | 371 | GGGCAGUG GCCGAAAGGCGAGUCAAGGUCU AGCUCACA | | 956 |
| 977 | GCUGCACU | G | CCCAGCCC | 372 | GGGCUGGG GCCGAAAGGCGAGUCAAGGUCU AGUGCAGC | | 957 |
| 1020 | GAGUCCAU | G | CCCAAUCC | 373 | GGAUUGGG GCCGAAAGGCGAGUCAAGGUCU AUGGACUC | | 958 |
| 1051 | CAUUCGGC | G | CCAGCUGU | 374 | ACAGCUGG GCCGAAAGGCGAGUCAAGGUCU GCCGAAUG | | 959 |
| 1066 | GUGUGACU | G | CCUGUCCC | 375 | GGGACAGG GCCGAAAGGCGAGUCAAGGUCU AGUCACAC | | 960 |
| 1106 | GGGAUCCU | G | CACCCUCG | 376 | CGAGGGUG GCCGAAAGGCGAGUCAAGGUCU AGGAUCCC | | 961 |
| 1118 | CCUCGUCU | G | CCCCCUGC | 377 | GCAGGGGG GCCGAAAGGCGAGUCAAGGUCU AGACGAGG | | 962 |
| 1125 | UGCCCCCU | G | CACAACCA | 378 | UGGUUGUG GCCGAAAGGCGAGUCAAGGUCU AGGGGGCA | | 963 |
| 1175 | UGAGAAGU | G | CAGCAAGC | 379 | GCUUGCUG GCCGAAAGGCGAGUCAAGGUCU ACUUCUCA | | 964 |
| 1189 | AGCCCUGU | G | CCCGAGUG | 380 | CACUCGGG GCCGAAAGGCGAGUCAAGGUCU AGGGCU | | 965 |
| 1199 | CCGAGUGU | G | CUAUGGUC | 381 | GACCAUAG GCCGAAAGGCGAGUCAAGGUCU ACACUCGG | | 966 |
| 1224 | GAGCACUU | G | CGAGAGGU | 382 | ACCUCUCG GCCGAAAGGCGAGUCAAGGUCU AAGUGCUC | | 967 |
| 1249 | UUACCAGU | G | CCAAUAUC | 383 | GAUAUUGG GCCGAAAGGCGAGUCAAGGUCU ACUGGUAA | | 968 |
| 1267 | AGGAGUUU | G | CUGGCAGU | 384 | ACUGCCAG GCCGAAAGGCGAGUCAAGGUCU AAACUCCU | | 969 |
| 1274 | UGCUGGCU | G | CAAGAAGA | 385 | UCUUCUUG GCCGAAAGGCGAGUCAAGGUCU AGCCAGCA | | 970 |
| 1305 | GCAUUUCU | G | CCGGAGAG | 386 | CUCUCCGG GCCGAAAGGCGAGUCAAGGUCU AGAAAUGC | | 971 |
| 1342 | CCAACACU | G | CCCCGCUC | 387 | GAGCGGGG GCCGAAAGGCGAGUCAAGGUCU AGUGUUGG | | 972 |
| 1347 | ACUGCCCC | G | CUCCAGCC | 388 | GGCUGGAG GCCGAAAGGCGAGUCAAGGUCU GGGGCAGU | | 973 |
| 1431 | GACAGCCU | G | CCUGACCU | 389 | AGGUCAGG GCCGAAAGGCGAGUCAAGGUCU AGGCUGUC | | 974 |
| 1458 | CAGAACCU | G | CAAGUAAU | 390 | AUUACUUG GCCGAAAGGCGAGUCAAGGUCU AGGUUCUG | | 975 |
| 1482 | CGAAUUCU | G | CACAAUGG | 391 | CCAUUGUG GCCGAAAGGCGAGUCAAGGUCU AGAAUUCG | | 976 |
| 1492 | ACAAUGGC | G | CUACUCUG | 392 | CAGAGUAG GCCGAAAGGCGAGUCAAGGUCU GCCAUUGU | | 977 |
| 1500 | GCCUACUC | G | CUGACCCU | 393 | AGGGUCAG GCCGAAAGGCGAGUCAAGGUCU GAGUAGGC | | 978 |
| 1509 | CUGACCCU | G | CAAGGGCU | 394 | AGCCCUUG GCCGAAAGGCGAGUCAAGGUCU AGGGUCAG | | 979 |
| 1539 | CUGGGGCU | G | CGCUCACU | 395 | AGUGAGCG GCCGAAAGGCGAGUCAAGGUCU AGCCCCAG | | 980 |
| 1541 | GGGGCUGC | G | CUCACUGA | 396 | UCAGUGAG GCCGAAAGGCGAGUCAAGGUCU GCAGCCCC | | 981 |
| 1598 | CCACCUCU | G | CUUCGUGC | 397 | GCACGAAG GCCGAAAGGCGAGUCAAGGUCU AGAGGUGG | | 982 |
| 1605 | UGCUUCGU | G | CACACGGU | 398 | ACCGUGUG GCCGAAAGGCGAGUCAAGGUCU ACGAAGCA | | 983 |
| 1614 | CACACGGU | G | CCCUGGGA | 399 | UCCCAGGG GCCGAAAGGCGAGUCAAGGUCU ACCGUGUG | | 984 |
| 1641 | CGGAACCC | G | CACCAAGC | 400 | GCUUGGUG GCCGAAAGGCGAGUCAAGGUCU GGGUUCCG | | 985 |
| 1653 | CAAGCUCU | G | CUCCACAC | 401 | GUGUGGAG GCCGAAAGGCGAGUCAAGGUCU AGAGCUUG | | 986 |
| 1663 | UCCACACU | G | CCAACCGG | 402 | CCGGUUGG GCCGAAAGGCGAGUCAAGGUCU AGUGUGGA | | 987 |
| 1706 | CCUGGCCU | G | CCACCAGC | 403 | GCUGGUGG GCCGAAAGGCGAGUCAAGGUCU AGGCCAGG | | 988 |
| 1718 | CCAGCUGU | G | CGCCCGAG | 404 | CUCGGGCG GCCGAAAGGCGAGUCAAGGUCU ACAGCUGG | | 989 |
| 1720 | AGCUGUGC | G | CCCGAGGG | 405 | CCCUCGGG GCCGAAAGGCGAGUCAAGGUCU GCACAGCU | | 990 |
| 1733 | AGGGCACU | G | CUGGGGUC | 406 | GACCCCAG GCCGAAAGGCGAGUCAAGGUCU AGUGCCCU | | 991 |

TABLE XVI-continued

Human HER2 Class II (zinzyme) Ribozyme and Target Sequence

| Pos | Substrate | | | Seq ID | Ribozyme | | | Rz Seq ID |
|---|---|---|---|---|---|---|---|---|
| 1766 | UGUCAACU | G | CAGCCAGU | 407 | ACUGGCUG | GCCGAAAGGCGAGUCAAGGUCU | AGUUGACA | 992 |
| 1793 | CCAGGAGU | G | CGUGGAGG | 408 | CCUCCACG | GCCGAAAGGCGAGUCAAGGUCU | ACUCCUGG | 993 |
| 1805 | GGAGGAAU | G | CCGAGUAC | 409 | GUACUCGG | GCCGAAAGGCGAGUCAAGGUCU | AUUCCUCC | 994 |
| 1815 | CGAGUACU | G | CAGGGGCU | 410 | AGCCCCUG | GCCGAAAGGCGAGUCAAGGUCU | AGUACUCG | 995 |
| 1843 | AUGUGAAU | G | CCAGGCAC | 411 | GUGCCUGG | GCCGAAAGGCGAGUCAAGGUCU | AUUCACAU | 996 |
| 1857 | CACUGUUU | G | CCGUGCCA | 412 | UGGCACGG | GCCGAAAGGCGAGUCAAGGUCU | AAACAGUG | 997 |
| 1862 | UUUGCCGU | G | CCACCCUG | 413 | CAGGGUGG | GCCGAAAGGCGAGUCAAGGUCU | ACGGCAAA | 998 |
| 1936 | UGGCCUGU | G | CCCACUAU | 414 | AUAGUGGG | GCCGAAAGGCGAGUCAAGGUCU | ACAGGCCA | 999 |
| 1961 | UCCCUUCU | G | CGUGGCCC | 415 | GGGCCACG | GCCGAAAGGCGAGUCAAGGUCU | AGAAGGGA | 1000 |
| 1970 | CGUGGCCC | G | CUGCCCCA | 416 | UGGGGCAG | GCCGAAAGGCGAGUCAAGGUCU | GGGCCACG | 1001 |
| 1973 | GGCCCGCU | G | CCCCAGCG | 417 | CGCUGGGG | GCCGAAAGGCGAGUCAAGGUCU | AGCGGGCC | 1002 |
| 2007 | UCCUACAU | G | CCCAUCUG | 418 | CAGAUGGG | GCCGAAAGGCGAGUCAAGGUCU | AUGUAGGA | 1003 |
| 2038 | AGGAGGGC | G | CAUGCCAG | 419 | CUGGCAUG | GCCGAAAGGCGAGUCAAGGUCU | GCCCUCCU | 1004 |
| 2042 | GGGCGCAU | G | CCAGCCUU | 420 | AAGGCUGG | GCCGAAAGGCGAGUCAAGGUCU | AUGCGCCC | 1005 |
| 2051 | CCAGCCUU | G | CCCCAUCA | 421 | UGAUGGGG | GCCGAAAGGCGAGUCAAGGUCU | AAGGCUGG | 1006 |
| 2063 | CAUCAACU | G | CACCCACU | 422 | AGUGGGUG | GCCGAAAGGCGAGUCAAGGUCU | AGUUGAUG | 1007 |
| 2099 | CAAGGGCU | G | CCCCGCCG | 423 | CGGCGGGG | GCCGAAAGGCGAGUCAAGGUCU | AGCCCUUG | 1008 |
| 2104 | GCUGCCCC | G | CCGAGCAG | 424 | CUGCUCGG | GCCGAAAGGCGAGUCAAGGUCU | GGGGCAGC | 1009 |
| 2143 | UCAUCUCU | G | CGGUGGUU | 425 | AACCACCG | GCCGAAAGGCGAGUCAAGGUCU | AGAGAUGA | 1010 |
| 2160 | GGCAUUCU | G | CUGGUCGU | 426 | ACGACCAG | GCCGAAAGGCGAGUCAAGGUCU | AGAAUGCC | 1011 |
| 2235 | UACACGAU | G | CGGAGACU | 427 | AGUCUCCG | GCCGAAAGGCGAGUCAAGGUCU | AUCGUGUA | 1012 |
| 2244 | CGGAGACU | G | CUGCAGGA | 428 | UCCUGCAG | GCCGAAAGGCGAGUCAAGGUCU | AGUCUCCG | 1013 |
| 2247 | AGACUGCU | G | CAGGAAAC | 429 | GUUUCCUG | GCCGAAAGGCGAGUCAAGGUCU | AGCAGUCU | 1014 |
| 2271 | GUGGAGCC | G | CUGACACC | 430 | GGUGUCAG | GCCGAAAGGCGAGUCAAGGUCU | GGCUCCAC | 1015 |
| 2292 | GGAGCGAU | G | CCCAACCA | 431 | UGGUUGGG | GCCGAAAGGCGAGUCAAGGUCU | AUCGCUCC | 1016 |
| 2304 | AACCAGGC | G | CAGAUGCG | 432 | CGCAUCUG | GCCGAAAGGCGAGUCAAGGUCU | GCCUGGUU | 1017 |
| 2310 | GCGCAGAU | G | CGGAUCCU | 433 | AGGAUCCG | GCCGAAAGGCGAGUCAAGGUCU | AUCUGCGC | 1018 |
| 2349 | GUGAAGGU | G | CUUGGAUC | 434 | GAUCCAAG | GCCGAAAGGCGAGUCAAGGUCU | ACCUUCAC | 1019 |
| 2362 | GAUCUGGC | G | CUUUUGGC | 435 | GCCAAAAG | GCCGAAAGGCGAGUCAAGGUCU | GCCAGAUC | 1020 |
| 2525 | UGUCUCCC | G | CCUUCUGG | 436 | CCAGAAGG | GCCGAAAGGCGAGUCAAGGUCU | GGGAGACA | 1021 |
| 2540 | GGGCAUCU | G | CCUGACAU | 437 | AUGUCAGG | GCCGAAAGGCGAGUCAAGGUCU | AGAUGCCC | 1022 |
| 2556 | UCCACGGU | G | CAGCUGGU | 438 | ACCAGCUG | GCCGAAAGGCGAGUCAAGGUCU | ACCGUGGA | 1023 |
| 2577 | CAGCUUAU | G | CCCUAUGG | 439 | CCAUAGGG | GCCGAAAGGCGAGUCAAGGUCU | AUAAGCUG | 1024 |
| 2588 | CUAUGGCU | G | CCUCUUAG | 440 | CUAAGAGG | GCCGAAAGGCGAGUCAAGGUCU | AGCCAUAG | 1025 |
| 2615 | GGAAAACC | G | CGGACGCC | 441 | GGCGUCCG | GCCGAAAGGCGAGUCAAGGUCU | GGUUUUCC | 1026 |
| 2621 | CCGCGGAC | G | CCUGGGCU | 442 | AGCCCAGG | GCCGAAAGGCGAGUCAAGGUCU | GUCCGCGG | 1027 |
| 2640 | CAGGACCU | G | CUGAACUG | 443 | CAGUUCAG | GCCGAAAGGCGAGUCAAGGUCU | AGGUCCUG | 1028 |
| 2655 | UGGUGUAU | G | CAGAUUGC | 444 | GCAAUCUG | GCCGAAAGGCGAGUCAAGGUCU | AUACACCA | 1029 |
| 2662 | UGCAGAUU | G | CCAAGGGG | 445 | CCCCUUGG | GCCGAAAGGCGAGUCAAGGUCU | AAUCUGCA | 1030 |
| 2691 | GAGGAUGU | G | CGGCUCGU | 446 | ACGAGCCG | GCCGAAAGGCGAGUCAAGGUCU | ACAUCCUC | 1031 |
| 2716 | ACUUGGCC | G | CUCGGAAC | 447 | GUUCCGAG | GCCGAAAGGCGAGUCAAGGUCU | GGCCAAGU | 1032 |
| 2727 | CGGAACGU | G | CUGGUCAA | 448 | UUGACCAG | GCCGAAAGGCGAGUCAAGGUCU | ACGUUCCG | 1033 |
| 2781 | GCUCGGCU | G | CUGGACAU | 449 | AUGUCCAG | GCCGAAAGGCGAGUCAAGGUCU | AGCCGAGC | 1034 |
| 2809 | AGUACCAU | G | CAGAUGGG | 450 | CCCAUCUG | GCCGAAAGGCGAGUCAAGGUCU | AUGGUACU | 1035 |
| 2826 | GGCAAGGU | G | CCCAUCAA | 451 | UUGAUGGG | GCCGAAAGGCGAGUCAAGGUCU | ACCUUGCC | 1036 |
| 2844 | UGGAUGGC | G | CUGGAGUC | 452 | GACUCCAG | GCCGAAAGGCGAGUCAAGGUCU | GCCAUCCA | 1037 |
| 2861 | CAUUCUCC | G | CCGGCGGU | 453 | ACCGCCGG | GCCGAAAGGCGAGUCAAGGUCU | GGAGAAUG | 1038 |
| 2976 | CCUGACCU | G | CUGGAAAA | 454 | UUUUCCAG | GCCGAAAGGCGAGUCAAGGUCU | AGGUCAGG | 1039 |
| 2997 | GAGCGGCU | G | CCCCAGCC | 455 | GGCUGGGG | GCCGAAAGGCGAGUCAAGGUCU | AGCCGCUC | 1040 |
| 3014 | CCCCAUCU | G | CACCAUUG | 456 | CAAUGGUG | GCCGAAAGGCGAGUCAAGGUCU | AGAUGGGG | 1041 |
| 3107 | AUUCUCCC | G | CAUGGCCA | 457 | UGGCCAUG | GCCGAAAGGCGAGUCAAGGUCU | GGGAGAAU | 1042 |
| 3128 | CCCCCAGC | G | CUUUGUGG | 458 | CCACAAAG | GCCGAAAGGCGAGUCAAGGUCU | GCUGGGGG | 1043 |
| 3191 | CUUCUACC | G | CUCACUGC | 459 | GCAGUGAG | GCCGAAAGGCGAGUCAAGGUCU | GGUAGAAG | 1044 |
| 3198 | CGCUCACU | G | CUGGAGGA | 460 | UCCUCCAG | GCCGAAAGGCGAGUCAAGGUCU | AGUGAGCG | 1045 |
| 3232 | UGGUGGAU | G | CUGAGGAG | 461 | CUCCUCAG | GCCGAAAGGCGAGUCAAGGUCU | AUCCACCA | 1046 |
| 3280 | CAGACCCU | G | CCCCGGCG | 462 | GCCGGGGC | GCCGAAAGGCGAGUCAAGGUCU | AGGGUCUG | 1047 |
| 3289 | CCCCGGGC | G | CUGGGGGC | 463 | GCCCCCAG | GCCGAAAGGCGAGUCAAGGUCU | GCCCGGGG | 1048 |
| 3317 | CAGGCACC | G | CAGCUCAU | 464 | AUGAGCUG | GCCGAAAGGCGAGUCAAGGUCU | GGUGCCUG | 1049 |
| 3468 | AAGGGGCU | G | CAAAGCCU | 465 | AGGCUUUG | GCCGAAAGGCGAGUCAAGGUCU | AGCCCCUU | 1050 |
| 3534 | GUACCCCU | G | CCCUCUGA | 466 | UCAGAGGG | GCCGAAAGGCGAGUCAAGGUCU | GGGGUAC | 1051 |
| 3559 | GCUACGUU | G | CCCCCCUG | 467 | CAGGGGGG | GCCGAAAGGCGAGUCAAGGUCU | AACGUAGC | 1052 |
| 3572 | CCUGACCU | G | CAGCCCCC | 468 | GGGGGCUG | GCCGAAAGGCGAGUCAAGGUCU | AGGUCAGG | 1053 |
| 3627 | CCCCCUUC | G | CCCCGAGA | 469 | UCUCGGGG | GCCGAAAGGCGAGUCAAGGUCU | GAAGGGGG | 1054 |
| 3645 | GGCCCUCU | G | CCUGCUGC | 470 | GCAGCAGG | GCCGAAAGGCGAGUCAAGGUCU | AGAGGGCC | 1055 |
| 3649 | CUCUGCCU | G | CUGCCCGA | 471 | UCGGGCAG | GCCGAAAGGCGAGUCAAGGUCU | AGGCAGAG | 1056 |
| 3652 | UGCCUGCU | G | CCCGACCU | 472 | AGGUCGGG | GCCGAAAGGCGAGUCAAGGUCU | AGCAGGCA | 1057 |
| 3661 | CCCGACCU | G | CUGGUGCC | 473 | GGCACCAG | GCCGAAAGGCGAGUCAAGGUCU | AGGUCGGG | 1058 |
| 3667 | CUGCUGGU | G | CCACUCUG | 474 | CAGAGUGG | GCCGAAAGGCGAGUCAAGGUCU | ACCAGCAG | 1059 |
| 3730 | ACGUUUU | G | CCUUUGGG | 475 | CCCAAAGG | GCCGAAAGGCGAGUCAAGGUCU | AAAACGU | 1060 |
| 3742 | UUGGGGGU | G | CCGUGGAG | 476 | CUCCACGG | GCCGAAAGGCGAGUCAAGGUCU | ACCCCCAA | 1061 |
| 3784 | GAGGAGCU | G | CqQCUCAG | 477 | CUGAGGGG | GCCGAAAGGCGAGUCAAGGUCU | AGCUCCUC | 1062 |
| 3808 | CUCCUCCU | G | CCUUCAGC | 478 | GCUGAAGG | GCCGAAAGGCGAGUCAAGGUCU | AGGAGGAG | 1063 |
| 3933 | CUGGACGU | G | CCAGUGUG | 479 | CACACUGG | GCCGAAAGGCGAGUCAAGGUCU | ACGUCCAG | 1064 |
| 3960 | CCAAGUCC | G | CAGAAGCC | 480 | GGCUUCUG | GCCGAAAGGCGAGUCAAGGUCU | GGACUUGG | 1065 |

TABLE XVI-continued

Human HER2 Class II (zinzyme) Ribozyme and Target Sequence

| Pos | Substrate | Seq ID | Ribozyme | Rz Seq ID |
|---|---|---|---|---|
| 4007 | UGACUUCU G CUGGCAUC | 481 | GAUGCCAG GCCGAAAGGCGAGUCAAGGUCU AGAAGUCA | 1066 |
| 4056 | GGGAACCU G CCAUGCCA | 482 | UGGCAUGG GCCGAAAGGCGAGUCAAGGUCU AGGUUCCC | 1067 |
| 4061 | CCUGCCAU G CCAGGAAC | 483 | GUUCCUGG GCCGAAAGGCGAGUCAAGGUCU AUGGCAGG | 1068 |
| 4094 | UCCUUCCU G CUUGAGUU | 484 | AACUCAAG GCCGAAAGGCGAGUCAAGGUCU AGGAAGGA | 1069 |
| 4179 | GAGGCCCU G CCCAAUGA | 485 | UCAUUGGG GCCGAAAGGCGAGUCAAGGUCU AGGGCCUC | 1070 |
| 4208 | CAGUGGAU G CCACAGCC | 486 | GGCUGUGG GCCGAAAGGCGAGUCAAGGUCU AUCCACUG | 1071 |
| 4351 | CUAGUACU G CCCCCCAU | 487 | AUGGGGGG GCCGAAAGGCGAGUCAAGGUCU AGUACUAG | 1072 |
| 4406 | UACAGAGU G CUUUUCUG | 488 | CAGAAAAG GCCGAAAGGCGAGUCAAGGUCU ACUCUGUA | 1073 |
| 192 | GCGGCCUU G UGCCGCUG | 489 | CAGCGGCA GCCGAAAGGCGAGUCAAGGUCU AAGGCCGC | 1074 |
| 249 | ACCCAAGU G UGCACCGG | 490 | CCGGUGCA GCCGAAAGGCGAGUCAAGGUCU ACUUGGGU | 1075 |
| 387 | GCCAGCCU G UCCUUCCU | 491 | AGGAAGGA GCCGAAAGGCGAGUCAAGGUCU AGGCUGGC | 1076 |
| 478 | UGCGGAUU G UGCGAGGC | 492 | GCCUCGCA GCCGAAAGGCGAGUCAAGGUCU AAUCCGCA | 1077 |
| 559 | CCACCCCU G UCACAGGG | 493 | CCCUGUGA GCCGAAAGGCGAGUCAAGGUCU AGGGGUGG | 1078 |
| 678 | ACGAUUUU G UGGAAGGA | 494 | UCCUUCCA GCCGAAAGGCGAGUCAAGGUCU AAAAUCGU | 1079 |
| 758 | CCACCCCU G UUCUCCGA | 495 | UCGGAGAA GCCGAAAGGCGAGUCAAGGUCU AGGGGUGG | 1080 |
| 768 | UCUCCGAU G UGUAAGGG | 496 | CCCUUACA GCCGAAAGGCGAGUCAAGGUCU AUCGGAGA | 1081 |
| 770 | UCCGAUGU G UAAGGGCU | 497 | AGCCCUUA GCCGAAAGGCGAGUCAAGGUCU ACAUCGGA | 1082 |
| 809 | UGAGGAUU G UCAGAGCC | 498 | GGCUCUGA GCCGAAAGGCGAGUCAAGGUCU AAUCCUCA | 1083 |
| 829 | CGCGCACU G UCUGUGCC | 499 | GGCACAGA GCCGAAAGGCGAGUCAAGGUCU AGUGCGCG | 1084 |
| 833 | CACUGUCU G UGCCGGUG | 500 | CACCGGCA GCCGAAAGGCGAGUCAAGGUCU AGACAGUG | 1085 |
| 845 | CGGUGGCU G UGCCCGCU | 501 | AGCGGGCA GCCGAAAGGCGAGUCAAGGUCU AGCCACCG | 1086 |
| 893 | UGAGCAGU G UGCUGCCG | 502 | CGGCAGCA GCCGAAAGGCGAGUCAAGGUCU ACUGCUCA | 1087 |
| 965 | UGGCAUCU G UGAGCUGC | 503 | GCAGCUCA GCCGAAAGGCGAGUCAAGGUCU AGAUGCCA | 1088 |
| 1058 | CGCCAGCU G UGUGACUG | 504 | CAGUCACA GCCGAAAGGCGAGUCAAGGUCU AGCUGGCG | 1089 |
| 1060 | CCAGCUGU G UGACUGCC | 505 | GGCAGUCA GCCGAAAGGCGAGUCAAGGUCU ACAGCUGG | 1090 |
| 1070 | GACUGCCU G UCCCUACA | 506 | UGUAGGGA GCCGAAAGGCGAGUCAAGGUCU AGGCAGUC | 1091 |
| 1166 | ACAGCGGU G UGAGAAGU | 507 | ACUUCUCA GCCGAAAGGCGAGUCAAGGUCU ACCGCUGU | 1092 |
| 1187 | CAAGCCCU G UGCCCGAG | 508 | CUCGGGCA GCCGAAAGGCGAGUCAAGGUCU AGGGCUUG | 1093 |
| 1197 | GCCCGAGU G UCUAUGG | 509 | CCAUAGCA GCCGAAAGGCGAGUCAAGGUCU ACUCGGGC | 1094 |
| 1371 | CUCCAAGU G UUUGAGAC | 510 | GUCUCAAA GCCGAAAGGCGAGUCAAGGUCU ACUUGGAG | 1095 |
| 1685 | GGACGAGU G UGUGGCG | 511 | CGCCCACA GCCGAAAGGCGAGUCAAGGUCU ACUCGUCC | 1096 |
| 1687 | ACGAGUGU G UGGGCGAG | 512 | CUCGCCCA GCCGAAAGGCGAGUCAAGGUCU ACACUCGU | 1097 |
| 1716 | CACCAGCU G UGCGCCCG | 513 | CGGGCGCA GCCGAAAGGCGAGUCAAGGUCU AGCUGGUG | 1098 |
| 1757 | CACCCAGU G UGUCAACU | 514 | AGUUGACA GCCGAAAGGCGAGUCAAGGUCU ACUGGGUG | 1099 |
| 1759 | CCCAGUGU G UCAACUGC | 515 | GCAGUUGA GCCGAAAGGCGAGUCAAGGUCU ACACUGGG | 1100 |
| 1837 | GGGAGUAU G UGAAUGCC | 516 | GGCAUUCA GCCGAAAGGCGAGUCAAGGUCU AUACUCCC | 1101 |
| 1853 | CAGGCACU G UUUGCCGU | 517 | ACGGCAAA GCCGAAAGGCGAGUCAAGGUCU AGUGCCUG | 1102 |
| 1874 | CCCUGAGU G UCAGCCCC | 518 | GGGGCUGA GCCGAAAGGCGAGUCAAGGUCU ACUCAGGG | 1103 |
| 1901 | AGUGACCU G UUUUGGAC | 519 | GUCCAAAA GCCGAAAGGCGAGUCAAGGUCU AGGUCACU | 1104 |
| 1925 | UGACCAGU G UGUGGCCU | 520 | AGGCCACA GCCGAAAGGCGAGUCAAGGUCU ACUGGUCA | 1105 |
| 1927 | ACCAGUGU G UGGCCUGU | 521 | ACAGGCCA GCCGAAAGGCGAGUCAAGGUCU ACACUGGU | 1106 |
| 1934 | UGUGGCCU G UGCCCACU | 522 | AGUGGGCA GCCGAAAGGCGAGUCAAGGUCU AGGCCACA | 1107 |
| 1984 | CCAGCGGU G UGAAACCU | 523 | AGGUUUCA GCCGAAAGGCGAGUCAAGGUCU ACCGCUGG | 1108 |
| 2075 | CCACUCCU G UGUGGACC | 524 | GGUCCACA GCCGAAAGGCGAGUCAAGGUCU AGGAGUGG | 1109 |
| 2077 | ACUCCUGU G UGGACCUG | 525 | CAGGUCCA GCCGAAAGGCGAGUCAAGGUCU ACAGGAGU | 1110 |
| 2410 | GGGAGAAU G UGAAAAUU | 526 | AAUUUUCA GCCGAAAGGCGAGUCAAGGUCU AUUCUCCC | 1111 |
| 2436 | AUCAAAGU G UUGAGGGA | 527 | UCCUCAA GCCGAAAGGCGAGUCAAGGUCU ACUUUGAU | 1112 |
| 2503 | UGGCUGGU G UGGGCUCC | 528 | GGAGCCCA GCCGAAAGGCGAGUCAAGGUCU ACCAGCCA | 1113 |
| 2518 | CCCCAUAU G UCUCCCGC | 529 | GCGGGAGA GCCGAAAGGCGAGUCAAGGUCU AUAUGGGG | 1114 |
| 2602 | UAGACCAU G UCCGGGAA | 530 | UUCCCGGA GCCGAAAGGCGAGUCAAGGUCU AUGGUCUA | 1115 |
| 2651 | GAACUGGU G UAUGCAGA | 531 | UCUGCAUA GCCGAAAGGCGAGUCAAGGUCU ACCAGUUC | 1116 |
| 2689 | UGGAGGAU G UGCGGCUC | 532 | GAGCCGCA GCCGAAAGGCGAGUCAAGGUCU AUCCUCCA | 1117 |
| 2749 | CCAACCAU G UCAAAAUU | 533 | AAUUUUGA GCCGAAAGGCGAGUCAAGGUCU AUGGUUGG | 1118 |
| 2887 | AGAGUGAU G UGUGGAGU | 534 | ACUCCACA GCCGAAAGGCGAGUCAAGGUCU AUCACUCU | 1119 |
| 2889 | AGUGAUGU G UGGAGUUA | 535 | UAACUCCA GCCGAAAGGCGAGUCAAGGUCU ACAUCACU | 1120 |
| 2902 | GUUAUGGU G UGCUGUGG | 536 | CCACAGCA GCCGAAAGGCGAGUCAAGGUCU ACCAUAAC | 1121 |
| 2908 | GUGUGACU G UGGGAG | 537 | CUCCCACA GCCGAAAGGCGAGUCAAGGUCU AGUCACAC | 1122 |
| 2910 | GUGACUGU G UGGGAGCU | 538 | AGCUCCCA GCCGAAAGGCGAGUCAAGGUCU ACAGUCAC | 1123 |
| 3025 | CCAUUGAU G UCUACAUG | 539 | CAUGUAGA GCCGAAAGGCGAGUCAAGGUCU AUCAAUGG | 1124 |
| 3047 | GGUCAAAU G UUGGAUGA | 540 | UCAUCCAA GCCGAAAGGCGAGUCAAGGUCU AUUUGACC | 1125 |
| 3068 | CUCUGAAU G UCGGCCAA | 541 | UUGGCCGA GCCGAAAGGCGAGUCAAGGUCU AUUCAGAG | 1126 |
| 3093 | GAGUUGGU G UCUGAAUU | 542 | AAUUCAGA GCCGAAAGGCGAGUCAAGGUCU ACCAACUC | 1127 |
| 3133 | AGCGCUUU G UGGUCAUC | 543 | GAUGACCA GCCGAAAGGCGAGUCAAGGUCU AAAGCGCU | 1128 |
| 3269 | CUUCUUCU G UCCAGACC | 544 | GGUCUGGA GCCGAAAGGCGAGUCAAGGUCU AGAAGAAG | 1129 |
| 3427 | GCUCCGAU G UAUUUGAU | 545 | AUCAAAUA GCCGAAAGGCGAGUCAAGGUCU AUCGGAGC | 1130 |
| 3592 | CUGAAUAU G UGAACCAG | 546 | CUGGUUCA GCCGAAAGGCGAGUCAAGGUCU AUAUUCAG | 1131 |
| 3607 | AGCCAGAU G UUCGGCCC | 547 | GGGCCGAA GCCGAAAGGCGAGUCAAGGUCU AUCUGGCU | 1132 |
| 3939 | GUGCCAGU G UGAACCAG | 548 | CUGGUUCA GCCGAAAGGCGAGUCAAGGUCU ACUGGCAC | 1133 |
| 3974 | GCCCUGAU G UGUCCUCA | 549 | UGAGGACA GCCGAAAGGCGAGUCAAGGUCU AUCAGGGC | 1134 |
| 3976 | CCUGAUGU G UCCUCAGG | 550 | CCUGAGGA GCCGAAAGGCGAGUCAAGGUCU ACAUCAGG | 1135 |
| 4072 | AGGAACCU G UCCUAAGG | 551 | CCUUAGGA GCCGAAAGGCGAGUCAAGGUCU AGGUUCCU | 1136 |
| 4162 | GAGUCUUU G UGGAUUCU | 552 | AGAAUCCA GCCGAAAGGCGAGUCAAGGUCU AAAGACUC | 1137 |
| 4300 | AAGGGAGU G UCUAAGAA | 553 | UUCUUAGA GCCGAAAGGCGAGUCAAGGUCU ACUCCCUU | 1138 |
| 4332 | CAGAGACU G UCCCUGAA | 554 | UUCAGGGA GCCGAAAGGCGAGUCAAGGUCU AGUCUCUG | 1139 |

TABLE XVI-continued

Human HER2 Class II (zinzyme) Ribozyme and Target Sequence

| Pos | Substrate | Seq ID | Ribozyme | Rz Seq ID |
|---|---|---|---|---|
| 4380 | GCAAUGGU G UCAGUAUC | 555 | GAUACUGA GCCGAAAGGCGAGUCAAGGUCU ACCAUUGC | 1140 |
| 4397 | CAGGCUUU G UACAGAGU | 556 | ACUCUGUA GCCGAAAGGCGAGUCAAGGUCU AAAGCCUG | 1141 |
| 4414 | GCUUUUCU G UUUAGUUU | 557 | AAACUAAA GCCGAAAGGCGAGUCAAGGUCU AGAAAAGC | 1142 |
| 4434 | CUUUUUUU G UUUUGUUU | 558 | AAACAAAA GCCGAAAGGCGAGUCAAGGUCU AAAAAAAG | 1143 |
| 4439 | UUUGUUUU G UUUUUUUA | 559 | UAAAAAA GCCGAAAGGCGAGUCAAGGUCU AAAACAAA | 1144 |
| 9 | AAGGGGAG G UAACCCUG | 560 | CAGGGUUA GCCGAAAGGCGAGUCAAGGUCU CUCCCCUU | 1145 |
| 18 | UAACCCUG G CCCCUUUG | 561 | CAAAGGGG GCCGAAAGGCGAGUCAAGGUCU CAGGGUUA | 1146 |
| 27 | CCCCUUUG G UCGGGCC | 562 | GGCCCCGA GCCGAAAGGCGAGUCAAGGUCU CAAAGGGG | 1147 |
| 33 | UGGUCGGG G CCCCGGGC | 563 | GCCCGGGG GCCGAAAGGCGAGUCAAGGUCU CCCGACCA | 1148 |
| 40 | GGCCCCGG G CAGCCGCG | 564 | CGCGGCUG GCCGAAAGGCGAGUCAAGGUCU CCGGGGCC | 1149 |
| 43 | CCCGGGCA G CCGCGCGC | 565 | GCGCGCGG GCCGAAAGGCGAGUCAAGGUCU UGCCCGGG | 1150 |
| 65 | CCCACGGG G CCCUUUAC | 566 | GUAAAGGG GCCGAAAGGCGAGUCAAGGUCU CCCGUGGG | 1151 |
| 89 | CGCGCCCG G CCCCCACC | 567 | GGUGGGGG GCCGAAAGGCGAGUCAAGGUCU CGGGCGCG | 1152 |
| 105 | CCCUCGCA G CACCCCGC | 568 | GCGGGGUG GCCGAAAGGCGAGUCAAGGUCU UGCGAGGG | 1153 |
| 130 | CCCUCCCA G CCGGGUCC | 569 | GGACCCGG GCCGAAAGGCGAGUCAAGGUCU UGGGAGGG | 1154 |
| 135 | CCAGCCGG G UCCAGCCG | 570 | CGGCUGGA GCCGAAAGGCGAGUCAAGGUCU CCGGCUGG | 1155 |
| 140 | CGGGUCCA G CCGGAGCC | 571 | GGCUCCGG GCCGAAAGGCGAGUCAAGGUCU UGGACCCG | 1156 |
| 146 | CAGCCGGA G CCAUGGGG | 572 | CCCCAUGG GCCGAAAGGCGAGUCAAGGUCU UCCGGCUG | 1157 |
| 154 | GCCAUGGG G CCGGAGCC | 573 | GGCUCCGG GCCGAAAGGCGAGUCAAGGUCU CCCAUGGC | 1158 |
| 160 | GGGCCGGA G CCGCAGUG | 574 | CACUGCGG GCCGAAAGGCGAGUCAAGGUCU UCCGGCCC | 1159 |
| 166 | GAGCCGCA G UGAGCACC | 575 | GGUGCUCA GCCGAAAGGCGAGUCAAGGUCU UGCGGCUC | 1160 |
| 170 | CGCAGUGA G CACCAUGG | 576 | CCAUGGUG GCCGAAAGGCGAGUCAAGGUCU UCACUGCG | 1161 |
| 180 | ACCAUGGA G CUGGCGGC | 577 | GCCGCCAG GCCGAAAGGCGAGUCAAGGUCU UCCAUGGU | 1162 |
| 184 | UGGAGCUG G CGGCCUUG | 578 | CAAGGCCG GCCGAAAGGCGAGUCAAGGUCU CAGCUCCA | 1163 |
| 187 | AGCUGGCG G CCUUGUGC | 579 | GCACAAGG GCCGAAAGGCGAGUCAAGGUCU CGCCAGCU | 1164 |
| 204 | CGCUGGGG G CUCCUCCU | 580 | AGGAGGAG GCCGAAAGGCGAGUCAAGGUCU CCCCAGCG | 1165 |
| 232 | CCCCCGGA G CCGCGAGC | 581 | GCUCGCGG GCCGAAAGGCGAGUCAAGGUCU UCCGGGGG | 1166 |
| 239 | AGCCGCGA G CACCCAAG | 582 | CUUGGGUG GCCGAAAGGCGAGUCAAGGUCU UCGCGGCU | 1167 |
| 247 | GCACCCAA G UGCACC | 583 | GGUGCACA GCCGAAAGGCGAGUCAAGGUCU UUGGGUGC | 1168 |
| 257 | GUGCACCG G CACAGACA | 584 | UGUCUGUG GCCGAAAGGCGAGUCAAGGUCU CGGUGCAC | 1169 |
| 270 | GACAUGAA G CUGCGGCU | 585 | AGCCGCAG GCCGAAAGGCGAGUCAAGGUCU UUCAUGUC | 1170 |
| 276 | AAGCUGCG G CUCCCUGC | 586 | GCAGGGAG GCCGAAAGGCGAGUCAAGGUCU CGCAGCUU | 1171 |
| 287 | CCCUGCCA G UCCCGAGA | 587 | UCUCGGGA GCCGAAAGGCGAGUCAAGGUCU UGGCAGGG | 1172 |
| 329 | CUACCAGG G CUGCCAGG | 588 | CCUGGCAG GCCGAAAGGCGAGUCAAGGUCU CCUGGUAG | 1173 |
| 337 | GCUGCCAG G UGGUGCAG | 589 | CUGCACCA GCCGAAAGGCGAGUCAAGGUCU CUGGCAGC | 1174 |
| 340 | GCCAGGUG G UGCAGGGA | 590 | UCCCUGCA GCCGAAAGGCGAGUCAAGGUCU CACCUGGC | 1175 |
| 383 | CAAUGCCA G CCUGUCCU | 591 | AGGACAGG GCCGAAAGGCGAGUCAAGGUCU UGGCAUUG | 1176 |
| 412 | UCCAGGAG G UGCAGGGC | 592 | GCCCUGCA GCCGAAAGGCGAGUCAAGGUCU CUCCUGGA | 1177 |
| 419 | GGUGCAGG G CUACGUGC | 593 | GCACGUAG GCCGAAAGGCGAGUCAAGGUCU CCUGCACC | 1178 |
| 424 | AGGGCUAC G UGCUCAUC | 594 | GAUGAGCA GCCGAAAGGCGAGUCAAGGUCU GUAGCCCU | 1179 |
| 445 | ACAACCAA G UGAGGCAG | 595 | CUGCCUCA GCCGAAAGGCGAGUCAAGGUCU UUGGUUGU | 1180 |
| 450 | CAAGUGAG G CAGGUCCC | 596 | GGGACCUG GCCGAAAGGCGAGUCAAGGUCU CUCACUUG | 1181 |
| 454 | UGAGGCAG G UCCCACUG | 597 | CAGUGGGA GCCGAAAGGCGAGUCAAGGUCU CUGCCUCA | 1182 |
| 468 | CUGCAGAG G CUGCGGAU | 598 | AUCCGCAG GCCGAAAGGCGAGUCAAGGUCU CUCUGCAG | 1183 |
| 485 | UGUGCGAG G CACCCAGC | 599 | GCUGGGUG GCCGAAAGGCGAGUCAAGGUCU CUCGCACA | 1184 |
| 492 | GGCACCCA G CUCUUUGA | 600 | UCAAAGAG GCCGAAAGGCGAGUCAAGGUCU UGGGUGCC | 1185 |
| 517 | AUGCCCUG G CCGUGCUA | 601 | UAGCACGG GCCGAAAGGCGAGUCAAGGUCU CAGGGCAU | 1186 |
| 520 | CCCUGGCC G UGCUAGAC | 602 | GUCUAGCA GCCGAAAGGCGAGUCAAGGUCU GGCCAGGG | 1187 |
| 568 | UCACAGGG G CCUCCCCA | 603 | UGGGGAGG GCCGAAAGGCGAGUCAAGGUCU CCCUGUGA | 1188 |
| 581 | CCCAGGAG G CCUGCGGG | 604 | CCCGCAGG GCCGAAAGGCGAGUCAAGGUCU CUCCUGGG | 1189 |
| 591 | CUGCGGGA G CUGCAGCU | 605 | AGCUGCAG GCCGAAAGGCGAGUCAAGGUCU UCCCGCAG | 1190 |
| 597 | GAGCUGCA G CUUCGAAG | 606 | CUUCGAAG GCCGAAAGGCGAGUCAAGGUCU UGCAGCUC | 1191 |
| 605 | GCUUCGAA G CCUCACAG | 607 | CUGUGAGG GCCGAAAGGCGAGUCAAGGUCU UUCGAAGC | 1192 |
| 631 | AAGGAGGG G UCUUGAUC | 608 | GAUCAAGA GCCGAAAGGCGAGUCAAGGUCU CCCUCCUU | 1193 |
| 642 | UUGAUCCA G CGGAACCC | 609 | GGGUUCCG GCCGAAAGGCGAGUCAAGGUCU UGGAUCAA | 1194 |
| 654 | AACCCCCA G CUCUGCUA | 610 | UAGCAGAG GCCGAAAGGCGAGUCAAGGUCU UGGGGGUU | 1195 |
| 708 | AACAACCA G CUGGCUCU | 611 | AGAGCCAG GCCGAAAGGCGAGUCAAGGUCU UGGUUGUU | 1196 |
| 712 | ACCAGCUG G CUCUCACA | 612 | UGUGAGAG GCCGAAAGGCGAGUCAAGGUCU CAGCUGGU | 1197 |
| 745 | GCUCUCGG G CCUGCCAC | 613 | GUGGCAGG GCCGAAAGGCGAGUCAAGGUCU CCGAGAGC | 1198 |
| 776 | GUGUAAGG G CUCCCGCU | 614 | AGCGGGAG GCCGAAAGGCGAGUCAAGGUCU CCUUACAC | 1199 |
| 797 | GGGAGAGA G UUCUGAGG | 615 | CCUCAGAA GCCGAAAGGCGAGUCAAGGUCU UCUCUCCC | 1200 |
| 815 | UUGUCAGA G CCUGACGC | 616 | GCGUCAGG GCCGAAAGGCGAGUCAAGGUCU UCUGACAA | 1201 |
| 839 | CUGUGCCG G UGGCUGUG | 617 | CACAGCCA GCCGAAAGGCGAGUCAAGGUCU CGGCACAG | 1202 |
| 842 | UGCCGGUG G CUGUGCCC | 618 | GGGCACAG GCCGAAAGGCGAGUCAAGGUCU CACCGGCA | 1203 |
| 861 | UGCAAGGG G CCACUGCC | 619 | GGCAGUGG GCCGAAAGGCGAGUCAAGGUCU CCCUUGCA | 1204 |
| 888 | UGCCAUGA G CAGUGUGC | 620 | GCACACUG GCCGAAAGGCGAGUCAAGGUCU UCAUGGCA | 1205 |
| 891 | CAUGAGCA G UGUGCUGC | 621 | GCAGCACA GCCGAAAGGCGAGUCAAGGUCU UGCUCAUG | 1206 |
| 902 | UGCUGCCG G CUGCACGG | 622 | CCGUGCAG GCCGAAAGGCGAGUCAAGGUCU CGGCAGCA | 1207 |
| 911 | CUGCACGG G CCCAAGC | 623 | GCUUGGGG GCCGAAAGGCGAGUCAAGGUCU CCGUGCAG | 1208 |
| 918 | GGCCCCAA G CACUCUGA | 624 | UCAGAGUG GCCGAAAGGCGAGUCAAGGUCU UUGGGGCC | 1209 |
| 934 | ACUGCCUA G CCUGCCUC | 625 | GAGGCAGG GCCGAAAGGCGAGUCAAGGUCU CAGGCAGU | 1210 |
| 956 | CAACCACA G UGGCAUCU | 626 | AGAUGCCA GCCGAAAGGCGAGUCAAGGUCU UGUGGUUG | 1211 |
| 959 | CCACAGUG G CAUCUGUG | 627 | CACAGAUG GCCGAAAGGCGAGUCAAGGUCU CACUGUGG | 1212 |
| 969 | AUCUGUGA G CUGCACUG | 628 | CAGUGCAG GCCGAAAGGCGAGUCAAGGUCU UCACAGAU | 1213 |

TABLE XVI-continued

Human HER2 Class II (zinzyme) Ribozyme and Target Sequence

| Pos | Substrate | Seq ID | Ribozyme | Rz Seq ID |
|---|---|---|---|---|
| 982 | ACUGCCCA G CCCUGGUC | 629 | GACCAGGG GCCGAAAGGCGAGUCAAGGUCU UGGGCAGU | 1214 |
| 988 | CAGCCCUG G UCACCUAC | 630 | GUAGGUGA GCCGAAAGGCGAGUCAAGGUCU CAGGGCUG | 1215 |
| 1008 | ACAGACAC G UUUGAGUC | 631 | GACUCAAA GCCGAAAGGCGAGUCAAGGUCU GUGUCUGU | 1216 |
| 1014 | ACGUUUGA G UCCAUGCC | 632 | GGCAUGGA GCCGAAAGGCGAGUCAAGGUCU UCAAACGU | 1217 |
| 1034 | UCCCGAGG G CCGGUAUA | 633 | UAUACCGG GCCGAAAGGCGAGUCAAGGUCU CCUCGGGA | 1218 |
| 1038 | GAGGGCCG G UAUACAUU | 634 | AAUGUAUA GCCGAAAGGCGAGUCAAGGUCU CGGCCCUC | 1219 |
| 1049 | UACAUUCG G CGCCAGCU | 635 | AGCUGGCG GCCGAAAGGCGAGUCAAGGUCU CGAAUGUA | 1220 |
| 1055 | CGGCGCCA G CUGUGUGA | 636 | UCACACAG GCCGAAAGGCGAGUCAAGGUCU UGGCGCCG | 1221 |
| 1096 | CUACGGAC G UGGGAUCC | 637 | GGAUCCCA GCCGAAAGGCGAGUCAAGGUCU GUCCGUAG | 1222 |
| 1114 | GCACCCUC G UCUGCCCC | 638 | GGGGCAGA GCCGAAAGGCGAGUCAAGGUCU GAGGGUGC | 1223 |
| 1138 | ACCAAGAG G UGACAGCA | 639 | UGCUGUCA GCCGAAAGGCGAGUCAAGGUCU CUCUUGGU | 1224 |
| 1144 | AGGUGACA G CAGAGGAU | 640 | AUCCUCUG GCCGAAAGGCGAGUCAAGGUCU UGUCACCU | 1225 |
| 1161 | GGAACACA G CGGUGUGA | 641 | UCACACCG GCCGAAAGGCGAGUCAAGGUCU UGUGUUCC | 1226 |
| 1164 | ACACAGCG G UGUGAGAA | 642 | UUCUCACA GCCGAAAGGCGAGUCAAGGUCU CGCUGUGU | 1227 |
| 1173 | UGUGAGAA G UGCAGCAA | 643 | UUGCUGCA GCCGAAAGGCGAGUCAAGGUCU UUCUCACA | 1228 |
| 1178 | GAAGUGCA G CAAGCCCU | 644 | AGGGCUUG GCCGAAAGGCGAGUCAAGGUCU UGCACUUC | 1229 |
| 1182 | UGCAGCAA G CCCUGUGC | 645 | GCACAGGG GCCGAAAGGCGAGUCAAGGUCU UUGCUGCA | 1230 |
| 1195 | GUGCCCGA G UGUGCUAU | 646 | AUAGCACA GCCGAAAGGCGAGUCAAGGUCU UCGGGCAC | 1231 |
| 1205 | GUGCUAUG G UCUGGGCC | 647 | UGCCCAGA GCCGAAAGGCGAGUCAAGGUCU CAUAGCAC | 1232 |
| 1211 | UGGUCUGG G CAUGGAGC | 648 | GCUCCAUG GCCGAAAGGCGAGUCAAGGUCU CCAGACCA | 1233 |
| 1218 | GGCAUGGA G CACUUGCG | 649 | CGCAAGUG GCCGAAAGGCGAGUCAAGGUCU UCCAUGCC | 1234 |
| 1231 | UGCGAGAG G UGAGGGCA | 650 | UGCCCUCA GCCGAAAGGCGAGUCAAGGUCU CUCUCGCA | 1235 |
| 1237 | AGGUGAGG G CAGUUACC | 651 | GGUAACUG GCCGAAAGGCGAGUCAAGGUCU CCUCACCU | 1236 |
| 1240 | UGAGGGCA G UUACCAGU | 652 | ACUGGUAA GCCGAAAGGCGAGUCAAGGUCU UGCCCUCA | 1237 |
| 1247 | AGUUACCA G UGCCAAUA | 653 | UAUUGGCA GCCGAAAGGCGAGUCAAGGUCU UGGUAACU | 1238 |
| 1263 | AUCCAGGA G UUUGCUGG | 654 | CCAGCAAA GCCGAAAGGCGAGUCAAGGUCU UCCUGGAU | 1239 |
| 1271 | GUUUGCUG G CUGCAAGA | 655 | UCUUGCAG GCCGAAAGGCGAGUCAAGGUCU CAGCAAAC | 1240 |
| 1292 | CUUUGGGA G CCUGGCAU | 656 | AUGCCAGG GCCGAAAGGCGAGUCAAGGUCU UCCCAAAG | 1241 |
| 1297 | GGAGCCUG G CAUUUCUG | 657 | CAGAAAUG GCCGAAAGGCGAGUCAAGGUCU CAGGCUCC | 1242 |
| 1313 | GCCGGAGA G CUUUGAUG | 658 | CAUCAAAG GCCGAAAGGCGAGUCAAGGUCU UCUCCGGC | 1243 |
| 1330 | GGGACCCA G CCUCCAAC | 659 | GUUGGAGG GCCGAAAGGCGAGUCAAGGUCU UGGGUCCC | 1244 |
| 1353 | CCGCUCCA G CCAGAGCA | 660 | UGCUCUGG GCCGAAAGGCGAGUCAAGGUCU UGGAGCGG | 1245 |
| 1359 | CAGCCAGA G CAGCUCCA | 661 | UGGAGCUG GCCGAAAGGCGAGUCAAGGUCU UCUGGCUG | 1246 |
| 1362 | CCAGAGCA G CUCCAAGU | 662 | ACUUGGAG GCCGAAAGGCGAGUCAAGGUCU UGCUCUGG | 1247 |
| 1369 | AGCUCCAA G UGUUUGAG | 663 | CUCAAACA GCCGAAAGGCGAGUCAAGGUCU UUGQAGCU | 1248 |
| 1397 | GAUCACAG G UUACCUAU | 664 | AUAGGUAA GCCGAAAGGCGAGUCAAGGUCU CUGUGAUC | 1249 |
| 1414 | ACAUCUCA G CAUGGCCG | 665 | CGGCCAUG GCCGAAAGGCGAGUCAAGGUCU UGAGAUGU | 1250 |
| 1419 | UCAGCAUG G CCGGACAG | 666 | CUGUCCGG GCCGAAAGGCGAGUCAAGGUCU CAUGCUGA | 1251 |
| 1427 | GCCGGACA G CCUGCCUG | 667 | CAGGCAGG GCCGAAAGGCGAGUCAAGGUCU UGUCCGGC | 1252 |
| 1442 | UGACCUCA G CGUCUUCC | 668 | GGAAGACG GCCGAAAGGCGAGUCAAGGUCU UGAGGUCA | 1253 |
| 1444 | ACCUCAGC G UCUUCCAG | 669 | CUGGAAGA GCCGAAAGGCGAGUCAAGGUCU GCUGAGGU | 1254 |
| 1462 | ACCUGCAA G UAAUCCGG | 670 | CCGGAUUA GCCGAAAGGCGAGUCAAGGUCU UUGCAGGU | 1255 |
| 1490 | GCACAAUG G CGCCUACU | 671 | AGUAGGCG GCCGAAAGGCGAGUCAAGGUCU CAUUGUGC | 1256 |
| 1515 | CUGCAAGG G CUGGGCAU | 672 | AUGCCCAG GCCGAAAGGCGAGUCAAGGUCU CCUUGCAG | 1257 |
| 1520 | AGGGCUGG G CAUCAGCU | 673 | AGCUGAUG GCCGAAAGGCGAGUCAAGGUCU CCAGCCCU | 1258 |
| 1526 | GGGCAUCA G CUGGCUGG | 674 | CCAGCCAG GCCGAAAGGCGAGUCAAGGUCU UGAUGCCC | 1259 |
| 1530 | AUCAGCUG G CUGGGGCU | 675 | AGCCCCAG GCCGAAAGGCGAGUCAAGGUCU CAGCUGAU | 1260 |
| 1536 | UGGCUGGG G CUGCGCUC | 676 | GAGCGCAG GCCGAAAGGCGAGUCAAGGUCU CCCAGCCA | 1261 |
| 1559 | GGAACUGG G CAGUGGAC | 677 | GUCCACUG GCCGAAAGGCGAGUCAAGGUCU CCAGUUCC | 1262 |
| 1562 | ACUGGGCA G UGGACUGG | 678 | CCAGUCCA GCCGAAAGGCGAGUCAAGGUCU UGCCCAGU | 1263 |
| 1570 | GUGGACUG G CCCUCAUC | 679 | GAUGAGGG GCCGAAAGGCGAGUCAAGGUCU CAGUCCAC | 1264 |
| 1603 | UCUGCUUC G UGCACACG | 680 | CGUGUGCA GCCGAAAGGCGAGUCAAGGUCU GAAGCAGA | 1265 |
| 1612 | UGCACACG G UGCCCUGG | 681 | CCAGGGCA GCCGAAAGGCGAGUCAAGGUCU CGUGUGCA | 1266 |
| 1626 | UGGGACCA G CUCUUUCG | 682 | CGAAAGAG GCCGAAAGGCGAGUCAAGGUCU UGGUCCCA | 1267 |
| 1648 | CGCACCAA G CUCUGCUC | 683 | GAGCAGAG GCCGAAAGGCGAGUCAAGGUCU UUGGUGCG | 1268 |
| 1671 | GCCAACCG G CCAGAGGA | 684 | UCCUCUGG GCCGAAAGGCGAGUCAAGGUCU CGGUUGGC | 1269 |
| 1683 | GAGGACGA G UGUGUGGG | 685 | CCCACACA GCCGAAAGGCGAGUCAAGGUCU UCGUCCUC | 1270 |
| 1691 | GUGUGUGG G CGAGGGCC | 686 | GGCCCUCG GCCGAAAGGCGAGUCAAGGUCU CCACACAC | 1271 |
| 1697 | GGGCGAGG G CCUGGCCU | 687 | AGGCCAGG GCCGAAAGGCGAGUCAAGGUCU CCUCGCCC | 1272 |
| 1702 | AGGGCCUG G CCUGCCAC | 688 | GUGGCAGG GCCGAAAGGCGAGUCAAGGUCU CAGGCCCU | 1273 |
| 1713 | UGCCACCA G CUGUGCGC | 689 | GCGCACAG GCCGAAAGGCGAGUCAAGGUCU UGGUGGCA | 1274 |
| 1728 | GCCCGAGG G CACUGCUG | 690 | CAGCAGUG GCCGAAAGGCGAGUCAAGGUCU CCUCGGGC | 1275 |
| 1739 | CUGCUGGG G UCCAGGGC | 691 | GCCCUGGA GCCGAAAGGCGAGUCAAGGUCU CCCAGCAG | 1276 |
| 1746 | GGUCCAGG G CCCACCCA | 692 | UGGGUGGG GCCGAAAGGCGAGUCAAGGUCU CCUGGACC | 1277 |
| 1755 | CCCACCCA G UGUGUCAA | 693 | UUGACACA GCCGAAAGGCGAGUCAAGGUCU UGGGUGGG | 1278 |
| 1769 | CAACUGCA G CCAGUUCC | 694 | GGAACUGG GCCGAAAGGCGAGUCAAGGUCU UGCAGUUG | 1279 |
| 1773 | UGCAGCCA G UUCCUUCG | 695 | CGAAGGAA GCCGAAAGGCGAGUCAAGGUCU UGGCUGCA | 1280 |
| 1784 | CCUUCGGG G CCAGGAGU | 696 | ACUCCUGG GCCGAAAGGCGAGUCAAGGUCU CCCGAAGG | 1281 |
| 1791 | GGCCAGGA G UGCGUGGA | 697 | UCCACGCA GCCGAAAGGCGAGUCAAGGUCU UCCUGGCC | 1282 |
| 1795 | AGGAGUGC G UGGAGGAA | 698 | UUCCUCCA GCCGAAAGGCGAGUCAAGGUCU GCACUCCU | 1283 |
| 1810 | AAUGCCGA G UACUGCAG | 699 | CUGCAGUA GCCGAAAGGCGAGUCAAGGUCU UCGGCAUU | 1284 |
| 1821 | CUGCAGGG G CUCCCCAG | 700 | CUGGGGAG GCCGAAAGGCGAGUCAAGGUCU CCCUGCAG | 1285 |
| 1833 | CCCAGGGA G UAUGUGAA | 701 | UUCACAUA GCCGAAAGGCGAGUCAAGGUCU UCCCUGGG | 1286 |
| 1848 | AAUGCCAG G CACUGUUU | 702 | AAACAGUG GCCGAAAGGCGAGUCAAGGUCU CUGGCAUU | 1287 |

TABLE XVI-continued

Human HER2 Class II (zinzyme) Ribozyme and Target Sequence

| Pos | Substrate | | | Seq ID | Ribozyme | | | Rz Seq ID |
|---|---|---|---|---|---|---|---|---|
| 1860 | UGUUUGCC | G | UGCCACCC | 703 | GGGUGGCA | GCCGAAAGGCGAGUCAAGGUCU | GGCAAACA | 1288 |
| 1872 | CACCCUGA | G | UGUCAGCC | 704 | GGCUGACA | GCCGAAAGGCGAGUCAAGGUCU | UCAGGGUG | 1289 |
| 1878 | GAGUGUCA | G | CCCCAGAA | 705 | UUCUGGGG | GCCGAAAGGCGAGUCAAGGUCU | UGACACUC | 1290 |
| 1889 | CCAGAAUG | G | CUCAGUGA | 706 | UCACUGAG | GCCGAAAGGCGAGUCAAGGUCU | CAUUCUGG | 1291 |
| 1894 | AUGGCUCA | G | UGACCUGU | 707 | ACAGGUCA | GCCGAAAGGCGAGUCAAGGUCU | UGAGCCAU | 1292 |
| 1915 | GACCGGAG | G | CUGACCAG | 708 | CUGGUCAG | GCCGAAAGGCGAGUCAAGGUCU | CUCCGGUC | 1293 |
| 1923 | GCUGACCA | G | UGUGUGGC | 709 | GCCACACA | GCCGAAAGGCGAGUCAAGGUCU | UGGUCAGC | 1294 |
| 1930 | AGUGUGUG | G | CCUGUGCC | 710 | GGCACAGG | GCCGAAAGGCGAGUCAAGGUCU | CACACACU | 1295 |
| 1963 | CCUUCUGC | G | UGGCCCGC | 711 | GCGGGCCA | GCCGAAAGGCGAGUCAAGGUCU | GCAGAAGG | 1296 |
| 1966 | UCUGCGUG | G | CCCGCUGC | 712 | GCAGCGGG | GCCGAAAGGCGAGUCAAGGUCU | CACGCAGA | 1297 |
| 1979 | CUGCCCCA | G | CGGUGUGA | 713 | UCACACCG | GCCGAAAGGCGAGUCAAGGUCU | UGGGGCAG | 1298 |
| 1982 | CCCCAGCG | G | UGUGAAAC | 714 | GUUUCACA | GCCGAAAGGCGAGUCAAGGUCU | CGCUGGGG | 1299 |
| 2019 | AUCUGGAA | G | UUUCCAGA | 715 | UCUGGAAA | GCCGAAAGGCGAGUCAAGGUCU | UUCCAGAU | 1300 |
| 2036 | UGAGGAGG | G | CGCAUGCC | 716 | GGCAUGCG | GCCGAAAGGCGAGUCAAGGUCU | CCUCCUCA | 1301 |
| 2046 | GCAUGCCA | G | CCUUGCCC | 717 | GGGCAAGG | GCCGAAAGGCGAGUCAAGGUCU | UGGCAUGC | 1302 |
| 2096 | UGACAAGG | G | CUGCCCCG | 718 | CGGGGCAG | GCCGAAAGGCGAGUCAAGGUCU | CCUUGUCA | 1303 |
| 2109 | CCCGCCGA | G | CAGAGAGC | 719 | GCUCUCUG | GCCGAAAGGCGAGUCAAGGUCU | UCGGCGGG | 1304 |
| 2116 | AGCAGAGA | G | CCAGCCCU | 720 | AGGGCUGG | GCCGAAAGGCGAGUCAAGGUCU | UCUCUGCU | 1305 |
| 2120 | GAGAGCCA | G | CCCUCUGA | 721 | UCAGAGGG | GCCGAAAGGCGAGUCAAGGUCU | UGGCUCUC | 1306 |
| 2130 | CCUCUGAC | G | UCCAUCAU | 722 | AUGAUGGA | GCCGAAAGGCGAGUCAAGGUCU | GUCAGAGG | 1307 |
| 2146 | UCUCUGCG | G | UGGUUGGC | 723 | GCCAACCA | GCCGAAAGGCGAGUCAAGGUCU | CGCAGAGA | 1308 |
| 2149 | CUGCGGUG | G | UUGGCAUU | 724 | AAUGCCAA | GCCGAAAGGCGAGUCAAGGUCU | CACCGCAG | 1309 |
| 2153 | GGUGGUUG | G | CAUUCUGC | 725 | GCAGAAUG | GCCGAAAGGCGAGUCAAGGUCU | CAACCACC | 1310 |
| 2164 | UUCUGCUG | G | UCGUGGUC | 726 | GACCACGA | GCCGAAAGGCGAGUCAAGGUCU | CAGCAGAA | 1311 |
| 2167 | UGCUGGUC | G | UGGUCUUG | 727 | CAAGACCA | GCCGAAAGGCGAGUCAAGGUCU | GACCAGCA | 1312 |
| 2170 | UGGUCGUG | G | UCUUGGGG | 728 | CCCCAAGA | GCCGAAAGGCGAGUCAAGGUCU | CAGGACCA | 1313 |
| 2179 | UCUUGGGG | G | UGGUCUUU | 729 | AAAGACCA | GCCGAAAGGCGAGUCAAGGUCU | CCCCAAGA | 1314 |
| 2182 | UGGGGGUG | G | UCUUUGGG | 730 | CCCAAAGA | GCCGAAAGGCGAGUCAAGGUCU | CACCCCCA | 1315 |
| 2202 | CUCAUCAA | G | CGACGGCA | 731 | UGCCGUCG | GCCGAAAGGCGAGUCAAGGUCU | UUGAUGAG | 1316 |
| 2208 | AAGCGACG | G | CAGCAGAA | 732 | UUCUGCUG | GCCGAAAGGCGAGUCAAGGUCU | CGUCGCUU | 1317 |
| 2211 | CGACGGCA | G | CAGAAGAU | 733 | AUCUUCUG | GCCGAAAGGCGAGUCAAGGUCU | UGCCGUCG | 1318 |
| 2226 | AUCCGGAA | G | UACACGAU | 734 | AUCGUGUA | GCCGAAAGGCGAGUCAAGGUCU | UUCCGGAU | 1319 |
| 2259 | GAAACGGA | G | CUGGUGGA | 735 | UCCACCAG | GCCGAAAGGCGAGUCAAGGUCU | UCCGUUUC | 1320 |
| 2263 | CGGAGCUG | G | UGGAGCCG | 736 | CGGCUCCA | GCCGAAAGGCGAGUCAAGGUCU | CAGCUCCG | 1321 |
| 2268 | CUGGUGGA | G | CCGCUGAC | 737 | GUCAGCGG | GCCGAAAGGCGAGUCAAGGUCU | UCCACCAG | 1322 |
| 2282 | GACACCUA | G | CGGAGCGA | 738 | UCGCUCCG | GCCGAAAGGCGAGUCAAGGUCU | UAGGUGUC | 1323 |
| 2287 | CUAGCGGA | G | CGAUGCCC | 739 | GGGCAUCG | GCCGAAAGGCGAGUCAAGGUCU | UCCGCUAG | 1324 |
| 2302 | CCAACCAG | G | CGCAGAUG | 740 | CAUCUGCG | GCCGAAAGGCGAGUCAAGGUCU | CUGGUUGG | 1325 |
| 2331 | GAGACGGA | G | CUGAGGAA | 741 | UUCCUCAG | GCCGAAAGGCGAGUCAAGGUCU | UCCGUCUC | 1326 |
| 2341 | UGAGGAAG | G | UGAAGGUG | 742 | CACCUUCA | GCCGAAAGGCGAGUCAAGGUCU | CUUCCUCA | 1327 |
| 2347 | AGGUGAAG | G | UGCUUGGA | 743 | UCCAAGCA | GCCGAAAGGCGAGUCAAGGUCU | CUUCACCU | 1328 |
| 2360 | UGGAUCUG | G | CGCUUUUG | 744 | CAAAAGCG | GCCGAAAGGCGAGUCAAGGUCU | CAGAUCCA | 1329 |
| 2369 | CGCUUUUG | G | CACAGUCU | 745 | AGACUGUG | GCCGAAAGGCGAGUCAAGGUCU | CAAAAGCG | 1330 |
| 2374 | UUGGCACA | G | UCUACAAG | 746 | CUUGUAGA | GCCGAAAGGCGAGUCAAGGUCU | UGUGCCAA | 1331 |
| 2384 | CUACAAGG | G | CAUCUGGA | 747 | UCCAGAUG | GCCGAAAGGCGAGUCAAGGUCU | CCUUGUAG | 1332 |
| 2422 | AAAUUCCA | G | UGGCCAUC | 748 | GAUGGCCA | GCCGAAAGGCGAGUCAAGGUCU | UGGAAUUU | 1333 |
| 2425 | UUCCAGUG | G | CCAUCAAA | 749 | UUUGAUGG | GCCGAAAGGCGAGUCAAGGUCU | CACUGGAA | 1334 |
| 2434 | CCAUCAAA | G | UGUUGAGG | 750 | CCUCAACA | GCCGAAAGGCGAGUCAAGGUCU | UUUGAUGG | 1335 |
| 2461 | CCCCCAAA | G | CCAACAAA | 751 | UUUGUUGG | GCCGAAAGGCGAGUCAAGGUCU | UUUGGGGG | 1336 |
| 2485 | UAGACGAA | G | CAUACGUG | 752 | CACGUAUG | GCCGAAAGGCGAGUCAAGGUCU | UUCGUCUA | 1337 |
| 2491 | AAGCAUAC | G | UGAUGGCU | 753 | AGCCAUCA | GCCGAAAGGCGAGUCAAGGUCU | GUAUGCUU | 1338 |
| 2497 | ACGUGAUG | G | CUGGUGUG | 754 | CACACCAG | GCCGAAAGGCGAGUCAAGGUCU | CAUCACGU | 1339 |
| 2501 | GAUGGCUG | G | UGUGGGCU | 755 | AGCCCACA | GCCGAAAGGCGAGUCAAGGUCU | CAGCCAUC | 1340 |
| 2507 | UGGUGUGG | G | CUCCCCAU | 756 | AUGGGGAG | GCCGAAAGGCGAGUCAAGGUCU | CCACACCA | 1341 |
| 2534 | CCUUCUGG | G | CAUCUGCC | 757 | GGCAGAUG | GCCGAAAGGCGAGUCAAGGUCU | CCAGAAGG | 1342 |
| 2554 | CAUCCACG | G | UGCAGCGG | 758 | CAGCGCCA | GCCGAAAGGCGAGUCAAGGUCU | CGUGGAUG | 1343 |
| 2559 | ACGUGCA | G | CUGGUGAC | 759 | GUCACCAG | GCCGAAAGGCGAGUCAAGGUCU | UGCACCGU | 1344 |
| 2563 | UGCAGCUG | G | UGACACAG | 760 | CUGUGUCA | GCCGAAAGGCGAGUCAAGGUCU | CAGCUGCA | 1345 |
| 2571 | GUGACACA | G | CUUAUGCC | 761 | GGCAUAAG | GCCGAAAGGCGAGUCAAGGUCU | UGUGUCAC | 1346 |
| 2585 | GCCCUAUG | G | CUGCCUCU | 762 | AGAGGCAG | GCCGAAAGGCGAGUCAAGGUCU | CAUAGGGC | 1347 |
| 2627 | ACGCCUGG | G | CUCCCAGG | 763 | CCUGGGAG | GCCGAAAGGCGAGUCAAGGUCU | CCAGGCGU | 1348 |
| 2649 | CUGAACUG | G | UGUAUGCA | 764 | UGCAUACA | GCCGAAAGGCGAGUCAAGGUCU | CAGUUCAG | 1349 |
| 2675 | GGGGAUGA | G | CUACCUGG | 765 | CCAGGUAG | GCCGAAAGGCGAGUCAAGGUCU | UCAUCCCC | 1350 |
| 2694 | GAUGUGCG | G | CUCGUACA | 766 | UGUACGAG | GCCGAAAGGCGAGUCAAGGUCU | CGCACAUC | 1351 |
| 2698 | UGCGGCUC | G | UACACAGG | 767 | CCUGUGUA | GCCGAAAGGCGAGUCAAGGUCU | GAGCCGCA | 1352 |
| 2713 | GGGACUUG | G | CCGCUCGG | 768 | CCGAGCGG | GCCGAAAGGCGAGUCAAGGUCU | CAAGUCCC | 1353 |
| 2725 | CUCGGAAC | G | UGCUGGUC | 769 | GACCAGCA | GCCGAAAGGCGAGUCAAGGUCU | GUUCCGAG | 1354 |
| 2731 | ACGUGCUG | G | UCAAGAGU | 770 | ACUCUUGA | GCCGAAAGGCGAGUCAAGGUCU | CAGCACGU | 1355 |
| 2738 | GGUCAAGA | G | UCCCAACC | 771 | GGUUGGGA | GCCGAAAGGCGAGUCAAGGUCU | UCUUGACC | 1356 |
| 2769 | GACUUCGG | G | CUGGCUCG | 772 | CGAGCCAG | GCCGAAAGGCGAGUCAAGGUCU | CCGAAGUC | 1357 |
| 2773 | UCGGGCUG | G | CUCGGCUG | 773 | CAGCCGAG | GCCGAAAGGCGAGUCAAGGUCU | CAGCCCGA | 1358 |
| 2778 | CUGGCUCG | G | CUGCUGGA | 774 | UCCAGCAG | GCCGAAAGGCGAGUCAAGGUCU | CGAGCCAG | 1359 |
| 2802 | GAGACAGA | G | UACCAUGC | 775 | GCAUGGUA | GCCGAAAGGCGAGUCAAGGUCU | UCUGUCUC | 1360 |
| 2819 | AGAUGGGG | G | CAAGGUGC | 776 | GCACCUUG | GCCGAAAGGCGAGUCAAGGUCU | CCCCAUCU | 1361 |

TABLE XVI-continued

Human HER2 Class II (zinzyme) Ribozyme and Target Sequence

| Pos | Substrate | Seq ID | Ribozyme | Rz Seq ID |
|---|---|---|---|---|
| 2824 | GGGGCAAG G UGCCCAUC | 777 | GAUGGGCA GCCGAAAGGCGAGUCAAGGUCU CUUGCCCC | 1362 |
| 2835 | CCCAUCAA G UGGAUGGC | 778 | GCCAUCCA GCCGAAAGGCGAGUCAAGGUCU UUGAUGGG | 1363 |
| 2842 | AGUGGAUG G CGCUGGAG | 779 | CUCCAGCG GCCGAAAGGCGAGUCAAGGUCU CAUCCACU | 1364 |
| 2850 | GCGCUGGA G UCCAUUCU | 780 | AGAAUGGA GCCGAAAGGCGAGUCAAGGUCU UCCAGCGC | 1365 |
| 2865 | CUCCGCCG G CGGUUCAC | 781 | GUGAACCG GCCGAAAGGCGAGUCAAGGUCU CGGCGGAG | 1366 |
| 2868 | CGCCGGCG G UUCACCCA | 782 | UGGGUGAA GCCGAAAGGCGAGUCAAGGUCU CGCCGGCG | 1367 |
| 2882 | CCACCAGA G UGAUGUGU | 783 | ACACAUCA GCCGAAAGGCGAGUCAAGGUCU UCUGGUGG | 1368 |
| 2894 | UGUGUGGA G UUAUGGUG | 784 | CACCAUAA GCCGAAAGGCGAGUCAAGGUCU UCCACACA | 1369 |
| 2900 | GAGUUAUG G UGUGACUG | 785 | CAGUCACA GCCGAAAGGCGAGUCAAGGUCU CAUAACUC | 1370 |
| 2916 | GUGUGGGA G CUGAUGAC | 786 | GUCAUCAG GCCGAAAGGCGAGUCAAGGUCU UCCCACAC | 1371 |
| 2932 | CUUUUGGG G CCAAACCU | 787 | AGGUUUGG GCCGAAAGGCGAGUCAAGGUCU CCCAAAAG | 1372 |
| 2956 | GGAUCCCA G CCCGGGAG | 788 | CUCCCGGG GCCGAAAGGCGAGUCAAGGUCU UGGGAUCC | 1373 |
| 2991 | AAGGGGGA G CGGCUGCC | 789 | GGCAGCCG GCCGAAAGGCGAGUCAAGGUCU UCCCCCUU | 1374 |
| 2994 | GGGGAGCG G CUGCCCCA | 790 | UGGGGCAG GCCGAAAGGCGAGUCAAGGUCU CGCUCCCC | 1375 |
| 3003 | CUGCCCCA G CCCCCCAU | 791 | AUGGGGGG GCCGAAAGGCGAGUCAAGGUCU UGGGGCAG | 1376 |
| 3040 | UGAUCAUG G UCAAAUGU | 792 | ACAUUUGA GCCGAAAGGCGAGUCAAGGUCU CAUGAUCA | 1377 |
| 3072 | GAAUGUCG G CCAAGAUU | 793 | AAUCUUGG GCCGAAAGGCGAGUCAAGGUCU CGACAUUC | 1378 |
| 3087 | UUCCGGGA G UUGGUGUC | 794 | GACACCAA GCCGAAAGGCGAGUCAAGGUCU UCCCGGAA | 1379 |
| 3091 | GGGAGUUG G UGUCUGAA | 795 | UUCAGACA GCCGAAAGGCGAGUCAAGGUCU CAACUCCC | 1380 |
| 3112 | CCCGCAUG G CCAGGGAC | 796 | GUCCCUGG GCCGAAAGGCGAGUCAAGGUCU CAUGCGGG | 1381 |
| 3126 | GACCCCCA G CGCUUUGU | 797 | ACAAAGCG GCCGAAAGGCGAGUCAAGGUCU UGGGGGUC | 1382 |
| 3136 | GCUUUGUG G UCAUCCAG | 798 | CUGGAUGA GCCGAAAGGCGAGUCAAGGUCU CACAAAGC | 1383 |
| 3158 | GGACUUGG G CCCAGUCC | 799 | UGGCUGGG GCCGAAAGGCGAGUCAAGGUCU CCAAGUCC | 1384 |
| 3163 | UGGGCCCA G CCAGUCCC | 800 | GGGACUGG GCCGAAAGGCGAGUCAAGGUCU UGGGCCCA | 1385 |
| 3167 | CCCAGCCA G UCCCUUGG | 801 | CCAAGGGA GCCGAAAGGCGAGUCAAGGUCU UGGCUGGG | 1386 |
| 3179 | CUUGGACA G CACCUUCU | 802 | AGAAGGUG GCCGAAAGGCGAGUCAAGGUCU UGUCCAAG | 1387 |
| 3226 | GGGACCUG G UGGAUGCU | 803 | AGCAUCCA GCCGAAAGGCGAGUCAAGGUCU CAGGUCCC | 1388 |
| 3240 | GCUGAGGA G UAUCUGGU | 804 | ACCAGAUA GCCGAAAGGCGAGUCAAGGUCU UCCUCAGC | 1389 |
| 3247 | AGUAUCUG G UACCCCAG | 805 | CUGGGGUA GCCGAAAGGCGAGUCAAGGUCU CAGAUACU | 1390 |
| 3255 | GUACCCCA G CAGGGCUU | 806 | AAGCCCUG GCCGAAAGGCGAGUCAAGGUCU UGGGGUAC | 1391 |
| 3260 | CCAGCAGG G CUUCUUCU | 807 | AGAAGAAG GCCGAAAGGCGAGUCAAGGUCU CCUGCUGG | 1392 |
| 3287 | UGCCCCGG G CGCUGGGG | 808 | CCCCAGCG GCCGAAAGGCGAGUCAAGGUCU CCGGGGCA | 1393 |
| 3296 | CGCUGGGG G CAUGGUCC | 809 | GGACCAUG GCCGAAAGGCGAGUCAAGGUCU CCCCAGCG | 1394 |
| 3301 | GGGGCAUG G UCCACCAC | 810 | GUGGUGGA GCCGAAAGGCGAGUCAAGGUCU CAUGCCCC | 1395 |
| 3312 | CACCACAG G CACCGCAG | 811 | CUGCGGUG GCCGAAAGGCGAGUCAAGGUCU CUGUGGUG | 1396 |
| 3320 | GCACCGCA G CUCAUCUA | 812 | UAGAUGAG GCCGAAAGGCGAGUCAAGGUCU UGCGGUGC | 1397 |
| 3335 | UACCAGGA G UGGCGGUG | 813 | CACCGCCA GCCGAAAGGCGAGUCAAGGUCU UCCUGGUA | 1398 |
| 3338 | CAGGAGUG G CGGUGGGG | 814 | CCCCACCG GCCGAAAGGCGAGUCAAGGUCU CACUCCUG | 1399 |
| 3341 | GAGUGGCG G UGGGGACC | 815 | GGUCCCCA GCCGAAAGGCGAGUCAAGGUCU CGCCACUC | 1400 |
| 3360 | ACACUAGG G CUGGAGCC | 816 | GGCUCCAG GCCGAAAGGCGAGUCAAGGUCU CCUAGUGU | 1401 |
| 3366 | GGGCUGGA G CCCUCUGA | 817 | UCAGAGGG GCCGAAAGGCGAGUCAAGGUCU UCCAGCCC | 1402 |
| 3382 | AAGAGGAG G CCCCCAGG | 818 | CCUGGGGG GCCGAAAGGCGAGUCAAGGUCU CUCCUCUU | 1403 |
| 3390 | GCCCCCAG G UCUCCACU | 819 | AGUGGAGA GCCGAAAGGCGAGUCAAGGUCU CUGGGGGC | 1404 |
| 3400 | CUCCACUG G CACCCUCC | 820 | GGAGGGUG GCCGAAAGGCGAGUCAAGGUCU CAGUGGAG | 1405 |
| 3415 | CCGAAGGG G CUGGCUCC | 821 | GGAGCCAG GCCGAAAGGCGAGUCAAGGUCU CCCUUCGG | 1406 |
| 3419 | AGGGGCUG G CUCCGAUG | 822 | CAUCGGAG GCCGAAAGGCGAGUCAAGGUCU CAGCCCCU | 1407 |
| 3437 | AUUUGAUG G UGACCUGG | 823 | CCAGGUCA GCCGAAAGGCGAGUCAAGGUCU CAUCAAAU | 1408 |
| 3454 | GAAUGGGG G CAGCCUGG | 824 | CCUUGGCA GCCGAAAGGCGAGUCAAGGUCU CCCCAUUC | 1409 |
| 3457 | UGGGGGCA G CCAAGGGG | 825 | CCCCUUGG GCCGAAAGGCGAGUCAAGGUCU UGCCCCCA | 1410 |
| 3465 | GCCAAGGG G CUGCAAAG | 826 | CUUUGCAG GCCGAAAGGCGAGUCAAGGUCU CCCUUGGC | 1411 |
| 3473 | GCUGCAAA G CCUCCCCA | 827 | UGGGGAGG GCCGAAAGGCGAGUCAAGGUCU UUUGCAGC | 1412 |
| 3494 | UGACCCCA G CCUCUCAC | 828 | GUGAGAGG GCCGAAAGGCGAGUCAAGGUCU UGGGGUCA | 1413 |
| 3504 | CCUCUACA G CGGUACAG | 829 | CUGUACCG GCCGAAAGGCGAGUCAAGGUCU UGUAGAGG | 1414 |
| 3507 | CUACAGCG G UACAGUGA | 830 | UCACUGUA GCCGAAAGGCGAGUCAAGGUCU CGCUGUAG | 1415 |
| 3512 | GCGGUACA G UGAGGACC | 831 | GGUCCUCA GCCGAAAGGCGAGUCAAGGUCU UGUACCGC | 1416 |
| 3526 | ACCCCACA G UACCCCUG | 832 | CAGGGGUA GCCGAAAGGCGAGUCAAGGUCU UGUGGGGU | 1417 |
| 3551 | GACUGAUG G CUACGUUG | 833 | CAACGUAG GCCGAAAGGCGAGUCAAGGUCU CAUCAGUC | 1418 |
| 3556 | AUGGCUAC G UUGCCCCC | 834 | GGGGGCAA GCCGAAAGGCGAGUCAAGGUCU GUAGCCAU | 1419 |
| 3575 | GACCUGCA G CCCCCAGC | 835 | GCUGGGGG GCCGAAAGGCGAGUCAAGGUCU UGCAGGUC | 1420 |
| 3582 | AGCCCCCA G CCUGAUA | 836 | UAUUCAGG GCCGAAAGGCGAGUCAAGGUCU UGGGGGCU | 1421 |
| 3600 | GUGAACCA G CCAGAUGU | 837 | ACAUCUGG GCCGAAAGGCGAGUCAAGGUCU UGGUUCAC | 1422 |
| 3612 | GAUGUUCG G CCCCAGCC | 838 | GGCUGGGG GCCGAAAGGCGAGUCAAGGUCU CGAACAUC | 1423 |
| 3618 | CGGCCCCA G CCCCCUUC | 839 | GAAGGGGG GCCGAAAGGCGAGUCAAGGUCU UGGGGCCG | 1424 |
| 3638 | CCGAGAGG G CCCUCUGC | 840 | GCAGAGGG GCCGAAAGGCGAGUCAAGGUCU CCUCUCGG | 1425 |
| 3665 | ACCUGCUG G UGCCACUC | 841 | GAGUGGCA GCCGAAAGGCGAGUCAAGGUCU CAGCAGGU | 1426 |
| 3681 | CUGGAAAG G CCCAAGAC | 842 | GUCUUGGG GCCGAAAGGCGAGUCAAGGUCU CUUUCCAG | 1427 |
| 3712 | AGAAUGGG G UCGUCAAA | 843 | UUUGACGA GCCGAAAGGCGAGUCAAGGUCU CCCAUUCU | 1428 |
| 3715 | AUGGGGUC G UCAAAGAC | 844 | GUCUUUGA GCCGAAAGGCGAGUCAAGGUCU GACCCCAU | 1429 |
| 3724 | UCAAAGAC G UUUUUGCC | 845 | GGCAAAAA GCCGAAAGGCGAGUCAAGGUCU GUCUUUGA | 1430 |
| 3740 | CUUUGGGG G UGCCGUGG | 846 | CCACGGCA GCCGAAAGGCGAGUCAAGGUCU CCCCAAAG | 1431 |
| 3745 | GGGGUGCC G UGGAGAAC | 847 | GUUCUCCA GCCGAAAGGCGAGUCAAGGUCU GGCACCCC | 1432 |
| 3759 | AACCCCGA G UACUUGAC | 848 | GUCAAGUA GCCGAAAGGCGAGUCAAGGUCU UCGGGGUU | 1433 |
| 3781 | AGGGAGGA G CUGCCCCU | 849 | AGGGGCAG GCCGAAAGGCGAGUCAAGGUCU UCCUCCCU | 1434 |
| 3792 | GCCCCUCA G CCCCACCC | 850 | GGGUGGGG GCCGAAAGGCGAGUCAAGGUCU UGAGGGGC | 1435 |

TABLE XVI-continued

Human HER2 Class II (zinzyme) Ribozyme and Target Sequence

| Pos | Substrate | | | Seq ID | Ribozyme | Rz Seq ID |
|---|---|---|---|---|---|---|
| 3815 | UGCCUUCA | G | CCCAGCCU | 851 | AGGCUGGG GCCGAAAGGCGAGUCAAGGUCU UGAAGGCA | 1436 |
| 3820 | UCAGCCCA | G | CCUUCGAC | 852 | GUCGAAGG GCCGAAAGGCGAGUCAAGGUCU UGGGCUGA | 1437 |
| 3861 | CCACCAGA | G | CGGGGGGC | 853 | GCCCCCCG GCCGAAAGGCGAGUCAAGGUCU UCUGGUGG | 1438 |
| 3868 | AGCGGGGG | G | CUCCACCC | 854 | GGGUGGAG GCCGAAAGGCGAGUCAAGGUCU CCCCCGCU | 1439 |
| 3878 | UCCACCCA | G | CACCUUCA | 855 | UGAAGGUG GCCGAAAGGCGAGUCAAGGUCU UGGGUGGA | 1440 |
| 3901 | CACCUACG | G | CAGAGAAC | 856 | GUUCUCUG GCCGAAAGGCGAGUCAAGGUCU CGUAGGUG | 1441 |
| 3915 | AACCCAGA | G | UACCUGGG | 857 | CCCAGGUA GCCGAAAGGCGAGUCAAGGUCU UCUGGGUU | 1442 |
| 3923 | GUACCUGG | G | UCUGGACG | 858 | CGUCCAGA GCCGAAAGGCGAGUCAAGGUCU CCAGGUAC | 1443 |
| 3931 | GUCUGGAC | G | UGCCAGUG | 859 | CACUGGCA GCCGAAAGGCGAGUCAAGGUCU GUCCAGAC | 1444 |
| 3937 | ACGUGCCA | G | UGUGAACC | 860 | GGUUCACA GCCGAAAGGCGAGUCAAGGUCU UGGCACGU | 1445 |
| 3951 | ACCAGAAG | G | CCAAGUCC | 861 | GGACUUGG GCCGAAAGGCGAGUCAAGGUCU CUUCUGGU | 1446 |
| 3956 | AAGGCCAA | G | UCCGCAGA | 862 | UCUGCGGA GCCGAAAGGCGAGUCAAGGUCU UUGGCCUU | 1447 |
| 3966 | CCGCAGAA | G | CCCUGAUG | 863 | CAUCAGGG GCCGAAAGGCGAGUCAAGGUCU UUCUGCGG | 1448 |
| 3987 | CUCAGGGA | G | CAGGGAAG | 864 | CUUCCCUG GCCGAAAGGCGAGUCAAGGUCU UCCCUGAG | 1449 |
| 3996 | CAGGGAAG | G | CCUGACUU | 865 | AAGUCAGG GCCGAAAGGCGAGUCAAGGUCU CUUCCCUG | 1450 |
| 4011 | UUCUGCUG | G | CAUCAAGA | 866 | UCUUGAUG GCCGAAAGGCGAGUCAAGGUCU CAGCAGAA | 1451 |
| 4021 | AUCAAGAG | G | UGGGAGGG | 867 | CCCUCCCA GCCGAAAGGCGAGUCAAGGUCU CUCUUGAU | 1452 |
| 4029 | GUGGGAGG | G | CCCUCCGA | 868 | UCGGAGGG GCCGAAAGGCGAGUCAAGGUCU CCUCCCAC | 1453 |
| 4100 | CUGCUUGA | G | UUCCCAGA | 869 | UCUGGGAA GCCGAAAGGCGAGUCAAGGUCU UCAAGCAG | 1454 |
| 4111 | CCCAGAUG | G | CUGGAAGG | 870 | CCUUCCAG GCCGAAAGGCGAGUCAAGGUCU CAUCUGGG | 1455 |
| 4121 | UGGAAGGG | G | UCCAGCCU | 871 | AGGCUGGA GCCGAAAGGCGAGUCAAGGUCU CCCUUCCA | 1456 |
| 4126 | GGGGUCCA | G | CCUCGUUG | 872 | CAACGAGG GCCGAAAGGCGAGUCAAGGUCU UGGACCCC | 1457 |
| 4131 | CCAGCCUC | G | UUGGAAGA | 873 | UCUUCCAA GCCGAAAGGCGAGUCAAGGUCU GAGGCUGG | 1458 |
| 4146 | GAGGAACA | G | CACUGGGG | 874 | CCCCAGUG GCCGAAAGGCGAGUCAAGGUCU UGUUCCUC | 1459 |
| 4156 | ACUGGGGA | G | UCUUUGUG | 875 | CACAAAGA GCCGAAAGGCGAGUCAAGGUCU UCCCCAGU | 1460 |
| 4174 | AUUCUGAG | G | CCCUGCCC | 876 | GGGCAGGG GCCGAAAGGCGAGUCAAGGUCU CUCAGAAU | 1461 |
| 4197 | ACUCUAGG | G | UCCAGUGG | 877 | CCACUGGA GCCGAAAGGCGAGUCAAGGUCU CCUAGAGU | 1462 |
| 4202 | AGGGUCCA | G | UGGAUGCC | 878 | GGCAUCCA GCCGAAAGGCGAGUCAAGGUCU UGGACCCU | 1463 |
| 4214 | AUGCCACA | G | CCCAGCUU | 879 | AAGCUGGG GCCGAAAGGCGAGUCAAGGUCU UGUGGCAU | 1464 |
| 4219 | ACAGCCCA | G | CUUGGCCC | 880 | GGGCCAAG GCCGAAAGGCGAGUCAAGGUCU UGGGCUGU | 1465 |
| 4224 | CCAGCUUG | G | CCCUUUCC | 881 | GGAAAGGG GCCGAAAGGCGAGUCAAGGUCU CAAGCUGG | 1466 |
| 4246 | GAUCCUGG | G | UACUGAAA | 882 | UUUCAGUA GCCGAAAGGCGAGUCAAGGUCU CCAGGAUC | 1467 |
| 4255 | UACUGAAA | G | CCUUAGGG | 883 | CCCUAAGG GCCGAAAGGCGAGUCAAGGUCU UUUCAGUA | 1468 |
| 4266 | UUAGGGAA | G | CUGGCCUG | 884 | CAGGCCAG GCCGAAAGGCGAGUCAAGGUCU UUCCCUAA | 1469 |
| 4270 | GGAAGCUG | G | CCUGAGAG | 885 | CUCUCAGG GCCGAAAGGCGAGUCAAGGUCU CAGCUUCC | 1470 |
| 4284 | GAGGGGAA | G | CGGCCCUA | 886 | UAGGGCCG GCCGAAAGGCGAGUCAAGGUCU UUCCCCUC | 1471 |
| 4287 | GGGAAGCG | G | CCCUAAGG | 887 | CCUUAGGG GCCGAAAGGCGAGUCAAGGUCU CGCUUCCC | 1472 |
| 4298 | CUAAGGGA | G | UGUCUAAG | 888 | CUUAGACA GCCGAAAGGCGAGUCAAGGUCU UCCCUUAG | 1473 |
| 4314 | GAACAAAA | G | CGACCCAU | 889 | AUGGGUCG GCCGAAAGGCGAGUCAAGGUCU UUUUGUUC | 1474 |
| 4346 | GAAACCUA | G | CUACUGCCC | 890 | GGGCAGUA GCCGAAAGGCGAGUCAAGGUCU UAGGUUUC | 1475 |
| 4372 | AAGGAACA | G | CAAUGGUG | 891 | CACCAUUG GCCGAAAGGCGAGUCAAGGUCU UGUUCCUU | 1476 |
| 4378 | CAGCAAUG | G | UGUCAGUA | 892 | UACUGACA GCCGAAAGGCGAGUCAAGGUCU CAUUGCUG | 1477 |
| 4384 | UGGUGUCA | G | UAUCCAGG | 893 | CCUGGAUA GCCGAAAGGCGAGUCAAGGUCU UGACACCA | 1478 |
| 4392 | GUAUCCAG | G | CUUUGUAC | 894 | GUACAAAG GCCGAAAGGCGAGUCAAGGUCU CUGGAUAC | 1479 |
| 4404 | UGUACAGA | G | UGCUUUUC | 895 | GAAAAGCA GCCGAAAGGCGAGUCAAGGUCU UCUGUACA | 1480 |
| 4419 | UCUGUUUA | G | UUUUUACU | 896 | AGUAAAAA GCCGAAAGGCGAGUCAAGGUCU UAAACAGA | 1481 |

Input Sequence =HSERB2R. Cut Site = G/Y
Stem Length = 8. Core Sequence = GCcgaaagGCGaGuCaaGGuCu
HSERB2R (Human c-erb-B-2 mRNA; 4473 bp)

TABLE XVII

Substrate Specificity for Class I Ribozymes

| Substrate sequence | Seq. ID No. | 1-9t mutation | $k_{rel}$ |
|---|---|---|---|
| 5'-GCCGU G GGUUGCAC ACCUUCC-3' | 1482 | w.t. | 1.00 |
| 5'-GCCGU G GGUUGCAC ACCUUCC-3' | 1482 | A57G | 2.5 |
| 5'-GCCGA G GGUUGCAC ACCUUCC-3' | 1483 | A57U | 0.24 |
| 5'-GCCGC G GGUUGCAC ACCUUCC-3' | 1484 | A57G | 0.66 |
| 5'-GCCGG G GGUUGCAC ACCUUCC-3' | 1485 | A57C | 0.57 |
| 5'-GCCGU U GGUUGCAC ACCUUCC-3' | 1486 | w.t. | 0.17 |
| 5'-GCCGU A GGUUGCAC ACCUUCC-3' | 1487 | w.t. | n.d. |
| 5'-GCCGU C GGUUGCAC ACCUUCC-3' | 1488 | w.t. | n.d. |
| 5'-GCCGU G GGUUGCAC ACCUUCC-3' | 1482 | C16U | 0.98 |
| 5'-GCCGU G UGUUGCAC ACCUUCC-3' | 1489 | C16G | n.d. |
| 5'-GCCGU G UGUUGCAC ACCUUCC-3' | 1489 | C16A | 0.65 |
| 5'-GCCGU G AGUUGCAC ACCUUCC-3' | 1490 | C16U | 0.45 |
| 5'-GCCGU G CGUUGCAC ACCUUCC-3' | 1491 | C16G | 0.73 |
| 5'-GCCGU G GGUUGCAC ACCUUU-3' | 1492 | w.t. | 0.89 |
| 5'-GCCGU G GGUUGCAC ACCU-3' | 1493 | w.t. | 1.0 |
| 5'-GCCGU G GGUUGCAC AC-3' | 1494 | w.t. | 0.67 |

SEQUENCE LISTING (1526 sequences)

SEQ ID NO: 1 - RNA, 16 nt, Hepatitis C Virus
augggggcgacacucc

SEQ ID NO: 2 - RNA, 16 nt, Hepatitis C Virus
uucacgcagaaagcgu

SEQ ID NO: 3 - RNA, 16 nt, Hepatitis C Virus
gccauggcguuaguau

SEQ ID NO: 4 - RNA, 16 nt, Hepatitis C Virus
ccauggcguuaguaug

SEQ ID NO: 5 - RNA, 16 nt, Hepatitis C Virus
gucgugcagccuccag

SEQ ID NO: 6 - RNA, 16 nt, Hepatitis C Virus
ggucugcggaaccggu

SEQ ID NO: 7 - RNA, 16 nt, Hepatitis C Virus
gaaccggugaguacac

SEQ ID NO: 8 - RNA, 16 nt, Hepatitis C Virus
acaccggaauugccag

SEQ ID NO: 9 - RNA, 16 nt, Hepatitis C Virus
gaauugccaggacgac

SEQ ID NO: 10 - RNA, 16 nt, Hepatitis C Virus
cgaccggguccuuucu

SEQ ID NO: 11 - RNA, 16 nt, Hepatitis C Virus
gaccggguccuuucuu

SEQ ID NO: 12 - RNA, 16 nt, Hepatitis C Virus
ugccuggagauuuggg

SEQ ID NO: 13 - RNA, 16 nt, Hepatitis C Virus
agacugcuagccgagu

SEQ ID NO: 14 - RNA, 16 nt, Hepatitis C Virus
guguugggucgcgaaa

SEQ ID NO: 15 - RNA, 16 nt, Hepatitis C Virus
uguugggucgcgaaag

SEQ ID NO: 16 - RNA, 16 nt, Hepatitis C Virus
gggucgcgaaaggccu

SEQ ID NO: 17 - RNA, 16 nt, Hepatitis C Virus
gaaaggccuuguggua

SEQ ID NO: 18 - RNA, 16 nt, Hepatitis C Virus
cuugugguacugccug

SEQ ID NO: 19 - RNA, 16 nt, Hepatitis C Virus
gauagggugcuugcga

SEQ ID NO: 20 - RNA, 16 nt, Hepatitis C Virus
agggugcuugcgagug

SEQ ID NO: 21 - RNA, 16 nt, Hepatitis C Virus
ugggggcgacacucca

SEQ ID NO: 22 - RNA, 16 nt, Hepatitis C Virus
cucccgggagagccau

SEQ ID NO: 23 - RNA, 16 nt, Hepatitis C Virus
ucccgggagagccaua

SEQ ID NO: 24 - RNA, 16 nt, Hepatitis C Virus
auaguggucugcggaa

SEQ ID NO: 25 - RNA, 16 nt, Hepatitis C Virus
ucugcggaaccgguga

SEQ ID NO: 26 - RNA, 16 nt, Hepatitis C Virus
uucuuggauaaccccg

SEQ ID NO: 27 - RNA, 16 nt, Hepatitis C Virus
accccgcucaaugccu

SEQ ID NO: 28 - RNA, 16 nt, Hepatitis C Virus
ucaaugccuggagauu

SEQ ID NO: 29 - RNA, 16 nt, Hepatitis C Virus
gauuugggcgugcccc

SEQ ID NO: 30 - RNA, 16 nt, Hepatitis C Virus
auuugggcgugccccc

SEQ ID NO: 31 - RNA, 16 nt, Hepatitis C Virus
uuugggcgugcccccg

SEQ ID NO: 32 - RNA, 16 nt, Hepatitis C Virus
ggcgugcccccgcaag

SEQ ID NO: 33 - RNA, 16 nt, Hepatitis C Virus
cccccgcaagacugcu

SEQ ID NO: 34 - RNA, 16 nt, Hepatitis C Virus
guacugccugauaggg

SEQ ID NO: 35 - RNA, 16 nt, Hepatitis C Virus
ugcuugcgagugcccc

SEQ ID NO: 36 - RNA, 16 nt, Hepatitis C Virus
cgagugccccgggagg

SEQ ID NO: 37 - RNA, 16 nt, Hepatitis C Virus
gccccgggaggucucg

SEQ ID NO: 38 - RNA, 16 nt, Hepatitis C Virus
ccccgggaggucucgu

SEQ ID NO: 39 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
ggagugucgcggaggaaacucccuucaaggacaucguccgggcccau

SEQ ID NO: 40 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
acgcuuucugggaggaaacucccuucaaggacaucguccggggugaa

SEQ ID NO: 41 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
auacuaacgcggaggaaacucccuucaaggacaucguccgggauggc

SEQ ID NO: 42 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cauacuaacgggaggaaacucccuucaaggacaucguccgggcaugg

SEQ ID NO: 43 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cuggaggcugggaggaaacucccuucaaggacaucguccgggacgac

SEQ ID NO: 44 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
accgguuccgggaggaaacucccuucaaggacaucguccgggagacc

SEQ ID NO: 45 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
guguacucacggaggaaacucccuucaaggacaucguccggggguuc

SEQ ID NO: 46 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cuggcaauucggaggaaacucccuucaaggacaucguccgggggugu

SEQ ID NO: 47 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
gucguccuggggaggaaacucccuucaaggacaucguccgggaauuc

SEQ ID NO: 48 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
agaaaggaccggaggaaacucccuucaaggacaucguccgggggucg

SEQ ID NO: 49 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
aagaaaggacggaggaaacucccuucaaggacaucguccgggcgguc

SEQ ID NO: 50 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cccaaaucucggaggaaacucccuucaaggacaucguccgggaggca

SEQ ID NO: 51 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
acucggcuagggaggaaacucccuucaaggacaucguccgggagucu

SEQ ID NO: 52 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
uuucgcgaccggaggaaacucccuucaaggacaucguccgggaacac

SEQ ID NO: 53 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cuuucgcgacggaggaaacucccuucaaggacaucguccgggcaaca

SEQ ID NO: 54 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
aggccuuucgggaggaaacucccuucaaggacaucguccggggaccc

SEQ ID NO: 55 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
uaccacaaggggaggaaacucccuucaaggacaucguccgggcuuuc

SEQ ID NO: 56 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
caggcaguacggaggaaacucccuucaaggacaucguccgggacaag

SEQ ID NO: 57 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
ucgcaagcacggaggaaacucccuucaaggacaucguccgggcuauc

SEQ ID NO: 58 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cacucgcaagggaggaaacucccuucaaggacaucguccgggacccu

SEQ ID NO: 59 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
uggagugucgggaggaaacucccuucaaggacaucguccgggcccca

SEQ ID NO: 60 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
auggcucuccggaggaaacucccuucaaggacaucguccggggggag

SEQ ID NO: 61 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
uauggcucucggaggaaacucccuucaaggacaucguccgggcggga

SEQ ID NO: 62 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
uuccgcagacggaggaaacucccuucaaggacaucguccgggacuau

SEQ ID NO: 63 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
ucaccgguucggaggaaacucccuucaaggacaucguccggggcaga

SEQ ID NO: 64 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cgggguuaucggaggaaacucccuucaaggacaucguccgggaagaa

SEQ ID NO: 65 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
aggcauugagggaggaaacucccuucaaggacaucguccgggggggu

SEQ ID NO: 66 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
aaucuccaggggaggaaacucccuucaaggacaucguccgggauuga

SEQ ID NO: 67 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
ggggcacgccggaggaaacucccuucaaggacaucguccgggaaauc

SEQ ID NO: 68 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
gggggcacgcggaggaaacucccuucaaggacaucguccgggcaaau

SEQ ID NO: 69 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cgggggcacgggaggaaacucccuucaaggacaucguccgggccaaa

SEQ ID NO: 70 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cuugcgggggggaggaaacucccuucaaggacaucguccgggacgcc

SEQ ID NO: 71 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
agcagucuugggaggaaacucccuucaaggacaucguccgggggggg

SEQ ID NO: 72 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cccuaucaggggaggaaacucccuucaaggacaucguccgggaguac

SEQ ID NO: 73 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
ggggcacucgggaggaaacucccuucaaggacaucguccgggaagca

SEQ ID NO: 74 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
ccucccggggggaggaaacucccuucaaggacaucguccgggacucg

SEQ ID NO: 75 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
cgagaccuccggaggaaacucccuucaaggacaucguccgggggggc

SEQ ID NO: 76 - RNA, 47 nt, Artificial Sequence
  Description of Artificial Sequence:  Enzymatic Nucleic Acid
  misc_feature (1)..(10): 2'-O-Methyl
  misc_feature (12)..(21): 2'-O-Methyl
  misc_feature (43)..(47): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (47)..(47): 3'-end phosphate attached to an inverted deoxyabasic moiety, in a 3'-3 orientation
acgagaccucggaggaaacucccuucaaggacaucguccgggcgggg

SEQ ID NO: 77 - RNA, 61 nt, Artificial Sequence
  Description of Artificial Sequence:  Enzymatic Nucleic Acid
  misc_feature (2)..(36): 2'-O-Methyl
  misc_feature (42)..(46): 2'-O-Methyl
  misc_feature (47)..(47): 2'-O-Methyl
  misc_feature (51)..(51): 2'-O-Methyl
  misc_feature (54)..(61): 2'-O-Methyl
  misc_feature (22)..(26): 2'-deoxy-2'-amino
  misc_feature (32)..(32): 2'-deoxy-2'-amino
  misc_feature (34)..(35): 2'-deoxy-2'-amino
  misc_feature (37)..(39): 2'-deoxy-2'-amino
  misc_feature (62)..(62): 3'-end phosphate attached to an inverted deoxyabasic moiety, in a 3'-3 orientation
ggaaaggugugcaaccggagucaucauaauggcuucccuucaaggacaucgccgggacggc

SEQ ID NO: 78 - RNA, 61 nt, Artificial Sequence
  Description of Artificial Sequence:  Enzymatic Nucleic Acid
  misc_feature (8)..(8): 2'-deoxy-2'-amino
  misc_feature (10)..(10): 2'-deoxy-2'-amino
  misc_feature (12)..(12): 2'-deoxy-2'-amino
  misc_feature (15)..(16): 2'-deoxy-2'-amino
  misc_feature (21)..(22): 2'-deoxy-2'-amino
  misc_feature (24)..(25): 2'-deoxy-2'-amino
  misc_feature (27)..(27): 2'-deoxy-2'-amino
  misc_feature (30)..(30): 2'-deoxy-2'-amino
  misc_feature (33)..(40): 2'-deoxy-2'-amino
  misc_feature (46)..(46): 2'-deoxy-2'-amino
  misc_feature (47)..(49): 2'-deoxy-2'-amino
  misc_feature (51)..(53): 2'-deoxy-2'-amino
  misc_feature (58)..(58): 2'-deoxy-2'-amino
  misc_feature (61)..(61): 2'-deoxy-2'-amino
  misc_feature (61)..(61): 3'-end phosphate attached to an inverted deoxyabasic moiety, in a 3'-3 orientation
ggaaaggugugcaaccggagucaucauaauggcucccuucaaggacaucguccgggacggc

SEQ ID NO: 79 - RNA, 72 nt, Artificial Sequence
  Description of Artificial Sequence:  Enzymatic Nucleic Acid
gggaggaggaagugccuggucagucacaccgagacuggcagacgcugaaaccgccgcgcucgcucccagucc

SEQ ID NO: 80 - RNA, 72 nt, Artificial Sequence
  Description of Artificial Sequence:  Enzymatic Nucleic Acid
gggaggaggaagugccugguaguaauauaaucguuacuacgagugcaaggucgccgcgcucgcucccagucc

SEQ ID NO: 81 - RNA, 71 nt, Artificial Sequence
  Description of Artificial Sequence:  Enzymatic Nucleic Acid
gggaggaggaagugccugguaguugcccgaacugugacuacgagugaggucgccgcgcucgcucccagucc

SEQ ID NO: 82 - RNA, 72 nt, Artificial Sequence
  Description of Artificial Sequence:  Enzymatic Nucleic Acid
gggaggaggaagugccuggcgaucagaugagaugauggcagacgcagagaccgccgcgcucgcucccagucc

SEQ ID NO: 83 - RNA, 71 nt, Artificial Sequence
  Description of Artificial Sequence:  Enzymatic Nucleic Acid
gggaggaggaagugccuggcgacugauacgaaaagucgcaguuucgaaaccgccgcgcucgcucccagucc

SEQ ID NO: 84 - RNA, 72 nt, Artificial Sequence
  Description of Artificial Sequence:  Enzymatic Nucleic Acid
gggaggaggaagugccuggcgacugauacgaaaagucgcagguuucgaaaccgccgcgcucgcucccagucc

SEQ ID NO: 85 - RNA, 69 nt, Artificial Sequence
  Description of Artificial Sequence:  Enzymatic Nucleic Acid
gggaggaggaagugccuuggcucagcauaagugagcagauugcgacaccgccgcgcucgcucccagucc

SEQ ID NO: 86 - RNA, 71 nt, Artificial Sequence
  Description of Artificial Sequence:  Enzymatic Nucleic Acid
gggaggaggaagugccuuggucauuaggaugacaaacguauacugaacacugccgcgcucgcucccagucc

SEQ ID NO: 87 - RNA, 13 nt, Homo sapiens
cauggagcuggcg

SEQ ID NO: 88 - RNA, 13 nt, Homo sapiens
gagcuggcggccu

SEQ ID NO: 89 - RNA, 15 nt, Homo sapiens
agcugcggcucccug

SEQ ID NO: 90 - RNA, 13 nt, Homo sapiens
ugcuccgccaccu

SEQ ID NO: 91 - RNA, 15 nt, Homo sapiens
augcuccgccaccuc

SEQ ID NO: 92 - RNA, 13 nt, Homo sapiens
accaaugccagcc

SEQ ID NO: 93 - RNA, 15 nt, Homo sapiens
gcucaucgcucacaa

SEQ ID NO: 94 - RNA, 13 nt, Homo sapiens
ggagcugcagcuu

SEQ ID NO: 95 - RNA, 15 nt, Homo sapiens
gggagcugcagcuuc

SEQ ID NO: 96 - RNA, 13 nt, Homo sapiens
gcugcagcuucga

SEQ ID NO: 97 - RNA, 15 nt, Homo sapiens
agcugcagcuucgaa

SEQ ID NO: 98 - RNA, 13 nt, Homo sapiens
agcucugcuacca

SEQ ID NO: 99 - RNA, 15 nt, Homo sapiens
cagcucugcuaccag

SEQ ID NO: 100 - RNA, 13 nt, Homo sapiens
cugacugcugcca

SEQ ID NO: 101 - RNA, 15 nt, Homo sapiens
acugacugcugccau

SEQ ID NO: 102 - RNA, 13 nt, Homo sapiens
acugcugccauga

SEQ ID NO: 103 - RNA, 15 nt, Homo sapiens
gacugcugccaugag

SEQ ID NO: 104 - RNA, 15 nt, Homo sapiens
gccaugagcagugug

SEQ ID NO: 105 - RNA, 13 nt, Homo sapiens
cugacugccuggc

SEQ ID NO: 106 - RNA, 15 nt, Homo sapiens
ucugacugccuggcc

SEQ ID NO: 107 - RNA, 13 nt, Homo sapiens
ugccuggccugcc

SEQ ID NO: 108 - RNA, 15 nt, Homo sapiens
cugccuggccugccu

SEQ ID NO: 109 - RNA, 13 nt, Homo sapiens
uggccugccucca

SEQ ID NO: 110 - RNA, 15 nt, Homo sapiens
cuggccugccuccac

SEQ ID NO: 111 - RNA, 13 nt, Homo sapiens
cugugagcugcac

SEQ ID NO: 112 - RNA, 15 nt, Homo sapiens
ucugugagcugcacu

SEQ ID NO: 113 - RNA, 13 nt, Homo sapiens
ugagcugcacugc

SEQ ID NO: 114 - RNA, 15 nt, Homo sapiens
gugagcugcacugcc

SEQ ID NO: 115 - RNA, 13 nt, Homo sapiens
gagugugcuaugg

SEQ ID NO: 116 - RNA, 15 nt, Homo sapiens
cgagugugcuauggu

SEQ ID NO: 117 - RNA, 13 nt, Homo sapiens
gcuauggucuggg

SEQ ID NO: 118 - RNA, 15 nt, Homo sapiens
ugcuauggucugggc

SEQ ID NO: 119 - RNA, 13 nt, Homo sapiens
gucugggcaugga

SEQ ID NO: 120 - RNA, 13 nt, Homo sapiens
uugggagccuggc

SEQ ID NO: 121 - RNA, 15 nt, Homo sapiens
uuugggagccuggca

SEQ ID NO: 122 - RNA, 15 nt, Homo sapiens
ccggagagcuuugau

SEQ ID NO: 123 - RNA, 13 nt, Homo sapiens
ucacagguuaccu

SEQ ID NO: 124 - RNA, 13 nt, Homo sapiens
aucucagcauggc

SEQ ID NO: 125 - RNA, 15 nt, Homo sapiens
caucucagcauggcc

SEQ ID NO: 126 - RNA, 13 nt, Homo sapiens
gcuggggcugcgc

SEQ ID NO: 127 - RNA, 13 nt, Homo sapiens
ggcugcgcucacu

SEQ ID NO: 128 - RNA, 15 nt, Homo sapiens
cugggcaguggacug

SEQ ID NO: 129 - RNA, 15 nt, Homo sapiens
gggaccagcucuuuc

SEQ ID NO: 130 - RNA, 13 nt, Homo sapiens
cacccaguguguc

SEQ ID NO: 131 - RNA, 15 nt, Homo sapiens
ccacccaguguguca

SEQ ID NO: 132 - RNA, 13 nt, Homo sapiens
cccagugugucaa

SEQ ID NO: 133 - RNA, 15 nt, Homo sapiens
acccagugugucaac

SEQ ID NO: 134 - RNA, 13 nt, Homo sapiens
cagugugucaacu

SEQ ID NO: 135 - RNA, 15 nt, Homo sapiens
ccagugugucaacug

SEQ ID NO: 136 - RNA, 13 nt, Homo sapiens
uucggggccagga

SEQ ID NO: 137 - RNA, 15 nt, Homo sapiens
cuucggggccaggag

SEQ ID NO: 138 - RNA, 13 nt, Homo sapiens
ucaacugcaccca

SEQ ID NO: 139 - RNA, 15 nt, Homo sapiens
aucaacugcacccac

SEQ ID NO: 140 - RNA, 13 nt, Homo sapiens
acuccugugugga

SEQ ID NO: 141 - RNA, 13 nt, Homo sapiens
cagagagccagcc

SEQ ID NO: 142 - RNA, 15 nt, Homo sapiens
gacugcugcaggaaa

SEQ ID NO: 143 - RNA, 15 nt, Homo sapiens
uggagccgcugacac

SEQ ID NO: 144 - RNA, 13 nt, Homo sapiens
aggaaggugaagg

SEQ ID NO: 145 - RNA, 13 nt, Homo sapiens
gugaaggugcuug

SEQ ID NO: 146 - RNA, 15 nt, Homo sapiens
ggugaaggugcuugg

SEQ ID NO: 147 - RNA, 13 nt, Homo sapiens
gaaggugcuugga

SEQ ID NO: 148 - RNA, 15 nt, Homo sapiens
ugaaggugcuuggau

SEQ ID NO: 149 - RNA, 15 nt, Homo sapiens
uacaagggcaucugg

SEQ ID NO: 150 - RNA, 15 nt, Homo sapiens
ggagaaugugaaaau

SEQ ID NO: 151 - RNA, 13 nt, Homo sapiens
gugauggcuggug

SEQ ID NO: 152 - RNA, 13 nt, Homo sapiens
uggcugguguggg

SEQ ID NO: 153 - RNA, 13 nt, Homo sapiens
gcaucugccugac

SEQ ID NO: 154 - RNA, 13 nt, Homo sapiens
cagcuggugacac

SEQ ID NO: 155 - RNA, 13 nt, Homo sapiens
gacacagcuuaug

SEQ ID NO: 156 - RNA, 15 nt, Homo sapiens
ugacacagcuuaugc

SEQ ID NO: 157 - RNA, 13 nt, Homo sapiens
cagauugccaagg

SEQ ID NO: 158 - RNA, 13 nt, Homo sapiens
ggaugagcuaccu

SEQ ID NO: 159 - RNA, 15 nt, Homo sapiens
gggaugagcuaccug

SEQ ID NO: 160 - RNA, 15 nt, Homo sapiens
gucaagagucccaac

SEQ ID NO: 161 - RNA, 13 nt, Homo sapiens
gggcuggcucggc

SEQ ID NO: 162 - RNA, 15 nt, Homo sapiens
uggcucggcugcugg

SEQ ID NO: 163 - RNA, 13 nt, Homo sapiens
ucggcugcuggac

SEQ ID NO: 164 - RNA, 15 nt, Homo sapiens
cucggcugcuggaca

SEQ ID NO: 165 - RNA, 13 nt, Homo sapiens
gacagaguaccau

SEQ ID NO: 166 - RNA, 15 nt, Homo sapiens
agacagaguaccaug

SEQ ID NO: 167 - RNA, 15 nt, Homo sapiens
guaccaugcagaugg

SEQ ID NO: 168 - RNA, 13 nt, Homo sapiens
augggggcaaggu

SEQ ID NO: 169 - RNA, 15 nt, Homo sapiens
gaugggggcaaggug

SEQ ID NO: 170 - RNA, 15 nt, Homo sapiens
gagugauguguggag

SEQ ID NO: 171 - RNA, 13 nt, Homo sapiens
gugacuguguggg

SEQ ID NO: 172 - RNA, 15 nt, Homo sapiens
ugugacuguguggga

SEQ ID NO: 173 - RNA, 13 nt, Homo sapiens
gacugugugggag

SEQ ID NO: 174 - RNA, 15 nt, Homo sapiens
ugacugugugggagc

SEQ ID NO: 175 - RNA, 13 nt, Homo sapiens
gugggagcugaug

SEQ ID NO: 176 - RNA, 15 nt, Homo sapiens
ugugggagcugauga

SEQ ID NO: 177 - RNA, 13 nt, Homo sapiens
uuuggggccaaac

SEQ ID NO: 178 - RNA, 15 nt, Homo sapiens
uuuuggggccaaacc

SEQ ID NO: 179 - RNA, 13 nt, Homo sapiens
auugaugucuaca

SEQ ID NO: 180 - RNA, 15 nt, Homo sapiens
cauugaugucuacau

SEQ ID NO: 181 - RNA, 13 nt, Homo sapiens
ucaaauguuggau

SEQ ID NO: 182 - RNA, 15 nt, Homo sapiens
gucaaauguuggaug

SEQ ID NO: 183 - RNA, 13 nt, Homo sapiens
ccgggaguuggug

SEQ ID NO: 184 - RNA, 15 nt, Homo sapiens
uccgggaguuggugu

SEQ ID NO: 185 - RNA, 13 nt, Homo sapiens
gaaggggcuggcu

SEQ ID NO: 186 - RNA, 13 nt, Homo sapiens
gggcuggcuccga

SEQ ID NO: 187 - RNA, 15 nt, Homo sapiens
ggggcuggcuccgau

SEQ ID NO: 188 - RNA, 13 nt, Homo sapiens
uugauggugaccu

SEQ ID NO: 189 - RNA, 15 nt, Homo sapiens
uuugauggugaccug

SEQ ID NO: 190 - RNA, 13 nt, Homo sapiens
ucuacagcgguac

SEQ ID NO: 191 - RNA, 15 nt, Homo sapiens
cucuacagcgguaca

SEQ ID NO: 192 - RNA, 15 nt, Homo sapiens
caaagacguuuuugc

SEQ ID NO: 193 - RNA, 13 nt, Homo sapiens
ccuccugccuuca

SEQ ID NO: 194 - RNA, 15 nt, Homo sapiens
uccuccugccuucag

SEQ ID NO: 195 - RNA, 13 nt, Homo sapiens
gggaaggccugac

SEQ ID NO: 196 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
cgccaggccgaaaggcgagucaaggucuuccaug

SEQ ID NO: 197 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
aggccggccgaaaggcgagucaaggucucagcuc

SEQ ID NO: 198 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cagggaggccgaaaggcgagucaaggucucgcagcu

SEQ ID NO: 199 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
aggugggccgaaaggcgagucaaggucuggagca

SEQ ID NO: 200 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gaggugggccgaaaggcgagucaaggucuggagcau

SEQ ID NO: 201 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ggcugggccgaaaggcgagucaaggucuauuggu

SEQ ID NO: 202 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
uugugaggccgaaaggcgagucaaggucugaugagc

SEQ ID NO: 203 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
aagcuggccgaaaggcgagucaaggucuagcucc

SEQ ID NO: 204 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gaagcuggccgaaaggcgagucaaggucuagcuccc

SEQ ID NO: 205 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ucgaaggccgaaaggcgagucaaggucuugcagc

SEQ ID NO: 206 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
uucgaaggccgaaaggcgagucaaggucuugcagcu

SEQ ID NO: 207 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ugguaggccgaaaggcgagucaaggucuagagcu

SEQ ID NO: 208 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cugguaggccgaaaggcgagucaaggucuagagcug

SEQ ID NO: 209 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uggcaggccgaaaggcgagucaaggucuagucag

SEQ ID NO: 210 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
auggcaggccgaaaggcgagucaaggucuagucagu

SEQ ID NO: 211 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ucaugggccgaaaggcgagucaaggucuagcagu

SEQ ID NO: 212 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cucaugggccgaaaggcgagucaaggucuagcaguc

SEQ ID NO: 213 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cacacuggccgaaaggcgagucaaggucuucauggc

SEQ ID NO: 214 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gccagggccgaaaggcgagucaaggucuagucag

SEQ ID NO: 215 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ggccagggccgaaaggcgagucaaggucuagucaga

SEQ ID NO: 216 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ggcagggccgaaaggcgagucaaggucucaggca

SEQ ID NO: 217 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
aggcagggccgaaaggcgagucaaggucucaggcag

SEQ ID NO: 218 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uggagggccgaaaggcgagucaaggucuaggcca

SEQ ID NO: 219 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
guggagggccgaaaggcgagucaaggucuaggccag

SEQ ID NO: 220 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gugcaggccgaaaggcgagucaaggucuucacag

SEQ ID NO: 221 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
agugcaggccgaaaggcgagucaaggucuucacaga

SEQ ID NO: 222 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gcaguggccgaaaggcgagucaaggucuagcuca

SEQ ID NO: 223 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ggcaguggccgaaaggcgagucaaggucuagcucac

SEQ ID NO: 224 - RNA, 37 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(17): 2'-O-Methyl
  misc_feature (21)..(21): 2'-O-Methyl
  misc_feature (23)..(26): 2'-O-Methyl
  misc_feature (29)..(29): 2'-O-Methyl
  misc_feature (31)..(36): 2'-O-Methyl
  misc_feature (19)..(19): 2'-deoxy-2'-amino
  misc_feature (30)..(30): 2'-deoxy-2'-amino
  misc_feature (37)..(37): 3'-end phosphate attached to an inverted deoxyabasic moiety, in a 3'-3 orientation
gcaguggccaauuuguggcgagucaaggucuagcuca

SEQ ID NO: 225 - RNA, 37 nt, Artificial Sequence; identical to SEQ ID NO: 224
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(17): 2'-O-Methyl
  misc_feature (21)..(21): 2'-O-Methyl
  misc_feature (23)..(26): 2'-O-Methyl
  misc_feature (29)..(29): 2'-O-Methyl
  misc_feature (31)..(36): 2'-O-Methyl
  misc_feature (19)..(19): 2'-deoxy-2'-amino
  misc_feature (30)..(30): 2'-deoxy-2'-amino
  misc_feature (37)..(37): 3'-end phosphate attached to an inverted deoxyabasic moiety, in a 3'-3 orientation

SEQ ID NO: 226 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(15): 2'-O-Methyl
  misc_feature (17)..(22): 2'-O-Methyl
  misc_feature (25)..(25): 2'-O-Methyl
  misc_feature (27)..(33): 2'-O-Methyl
  misc_feature (16)..(16): 2'-deoxy-2'-amino
  misc_feature (26)..(26): 2'-deoxy-2'-amino
  misc_feature (33)..(33): 3'-end phosphate attached to an inverted deoxyabasic moiety, in a 3'-3 orientation
gcaguggccgaaaggcgagugaggucuagcuca

SEQ ID NO: 227 - RNA, 33 nt, Artificial Sequence; identical to SEQ ID NO: 226
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(33): 2'-O-Methyl
  misc_feature (16)..(16): 2'-deoxy-2'-amino
  misc_feature (27)..(27): 2'-deoxy-2'-amino
  misc_feature (33)..(33): 3'-end phosphate attached to an inverted deoxyabasic moiety, in a 3'-3 orientation

SEQ ID NO: 228 - RNA, 43 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(11): 2'-O-Methyl
  misc_feature (14)..(16): 2'-O-Methyl
  misc_feature (18)..(18): 2'-O-Methyl
  misc_feature (21)..(23): 2'-O-Methyl
  misc_feature (27)..(27): 2'-O-Methyl
  misc_feature (29)..(32): 2'-O-Methyl
  misc_feature (34)..(34): 2'-O-Methyl
  misc_feature (36)..(43): 2'-O-Methyl
  misc_feature (25)..(25): 2'-deoxy-2'-amino
  misc_feature (36)..(36): 2'-deoxy-2'-amino
  misc_feature (43)..(43): 3'-end phosphate attached to an inverted deoxyabasic moiety, in a 3'-3 orientation
gcaguggccacaauuuguggcaggcgagucaaggucuagcuca

SEQ ID NO: 229 - RNA, 33 nt, Artificial Sequence; identical to SEQ ID NO: 226
  Description of Artificial Sequence:  Enzymatic Nucleic Acid
  misc_feature (1)..(4): Phosphorothioate 3'-Internucleotide Linkage
  misc_feature (1)..(15): 2'-O-Methyl
  misc_feature (17)..(25): 2'-O-Methyl
  misc_feature (27)..(33): 2'-O-Methyl
  misc_feature (16)..(16): 2'-deoxy-2'-amino
  misc_feature (26)..(26): 2'-deoxy-2'-amino
  misc_feature (33)..(33): 3'-end phosphate attached to an inverted deoxyabasic moiety, in a 3'-3 orientation

SEQ ID NO: 230 - RNA, 33 nt, Artificial Sequence; identical to SEQ ID NO: 226
  Description of Artificial Sequence:  Enzymatic Nucleic Acid
  misc_feature (1)..(4): Phosphorothioate 3'-Internucleotide Linkage
  misc_feature (1)..(15): 2'-O-Methyl
  misc_feature (17)..(25): 2'-O-Methyl
  misc_feature (27)..(33): 2'-O-Methyl
  misc_feature (16)..(16): 2'-deoxy-2'-amino
  misc_feature (26)..(26): 2'-deoxy-2'-amino
  misc_feature (33)..(33): 3'-end phosphate attached to an inverted deoxyabasic moiety, in a 3'-3 orientation

SEQ ID NO: 231 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ccauaggccgaaaggcgagucaaggucuacacuc

SEQ ID NO: 232 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
accauaggccgaaaggcgagucaaggucuacacucg

SEQ ID NO: 233 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
cccagagccgaaaggcgagucaaggucucauagc

SEQ ID NO: 234 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gcccagagccgaaaggcgagucaaggucucauagca

SEQ ID NO: 235 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uccauggccgaaaggcgagucaaggucuccagac

SEQ ID NO: 236 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gccagggccgaaaggcgagucaaggucuucccaa

SEQ ID NO: 237 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ugccagggccgaaaggcgagucaaggucuucccaaa

SEQ ID NO: 238 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
aucaaaggccgaaaggcgagucaaggucuucuccgg

SEQ ID NO: 239 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
agguaagccgaaaggcgagucaaggucucuguga

SEQ ID NO: 240 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gccauggccgaaaggcgagucaaggucuugagau

SEQ ID NO: 241 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ggccauggccgaaaggcgagucaaggucuugagaug

SEQ ID NO: 242 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gcgcaggccgaaaggcgagucaaggucucccagc

SEQ ID NO: 243 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
agugaggccgaaaggcgagucaaggucugcagcc

SEQ ID NO: 244 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
caguccagccgaaaggcgagucaaggucuugcccag

SEQ ID NO: 245 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gaaagaggccgaaaggcgagucaaggucuugguccc

SEQ ID NO: 246 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gacacagccgaaaggcgagucaaggucuugggug

SEQ ID NO: 247 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ugacacagccgaaaggcgagucaaggucuugggugg

SEQ ID NO: 248 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uugacagccgaaaggcgagucaaggucuacuggg

SEQ ID NO: 249 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
guugacagccgaaaggcgagucaaggucuacugggu

SEQ ID NO: 250 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
aguugagccgaaaggcgagucaaggucuacacug

SEQ ID NO: 251 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
caguugagccgaaaggcgagucaaggucuacacugg

SEQ ID NO: 252 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uccugggccgaaaggcgagucaaggucucccgaa

SEQ ID NO: 253 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cuccugggccgaaaggcgagucaaggucucccgaag

SEQ ID NO: 254 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uggguggccgaaaggcgagucaaggucuaguuga

SEQ ID NO: 255 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
guggguggccgaaaggcgagucaaggucuaguugau

SEQ ID NO: 256 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uccacagccgaaaggcgagucaaggucuaggagu

SEQ ID NO: 257 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ggcugggccgaaaggcgagucaaggucuucucug

SEQ ID NO: 258 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
uuuccuggccgaaaggcgagucaaggucuagcaguc

SEQ ID NO: 259 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gugucaggccgaaaggcgagucaaggucuggcucca

SEQ ID NO: 260 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ccuucagccgaaaggcgagucaaggucucuuccu

SEQ ID NO: 261 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
caagcagccgaaaggcgagucaaggucucuucac

SEQ ID NO: 262 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ccaagcagccgaaaggcgagucaaggucucuucacc

SEQ ID NO: 263 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uccaaggccgaaaggcgagucaaggucuaccuuc

SEQ ID NO: 264 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
auccaaggccgaaaggcgagucaaggucuaccuuca

SEQ ID NO: 265 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ccagauggccgaaaggcgagucaaggucuccuugua

SEQ ID NO: 266 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
auuuucagccgaaaggcgagucaaggucuauucucc

SEQ ID NO: 267 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
caccaggccgaaaggcgagucaaggucucaucac

SEQ ID NO: 268 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
cccacagccgaaaggcgagucaaggucucagcca

SEQ ID NO: 269 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gucagggccgaaaggcgagucaaggucuagaugc

SEQ ID NO: 270 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gugucagccgaaaggcgagucaaggucucagcug

SEQ ID NO: 271 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
cauaaggccgaaaggcgagucaaggucuuguguc

SEQ ID NO: 272 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gcauaaggccgaaaggcgagucaaggucuuguguca

SEQ ID NO: 273 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ccuugggccgaaaggcgagucaaggucuaaucug

SEQ ID NO: 274 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
agguaggccgaaaggcgagucaaggucuucaucc

SEQ ID NO: 275 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cagguaggccgaaaggcgagucaaggucuucauccc

SEQ ID NO: 276 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
guugggagccgaaaggcgagucaaggucuucuugac

SEQ ID NO: 277 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gccgaggccgaaaggcgagucaaggucucagccc

SEQ ID NO: 278 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ccagcaggccgaaaggcgagucaaggucucgagcca

SEQ ID NO: 279 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
guccaggccgaaaggcgagucaaggucuagccga

SEQ ID NO: 280 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
uguccaggccgaaaggcgagucaaggucuagccgag

SEQ ID NO: 281 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
augguagccgaaaggcgagucaaggucuucuguc

SEQ ID NO: 282 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
caugguagccgaaaggcgagucaaggucuucugucu

SEQ ID NO: 283 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ccaucuggccgaaaggcgagucaaggucuaugguac

SEQ ID NO: 284 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
accuuggccgaaaggcgagucaaggucuccccau

SEQ ID NO: 285 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
caccuuggccgaaaggcgagucaaggucuccccauc

SEQ ID NO: 286 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cuccacagccgaaaggcgagucaaggucuaucacuc

SEQ ID NO: 287 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
cccacagccgaaaggcgagucaaggucuagucac

SEQ ID NO: 288 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ucccacagccgaaaggcgagucaaggucuagucaca

SEQ ID NO: 289 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
cucccagccgaaaggcgagucaaggucuacaguc

SEQ ID NO: 290 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gcucccagccgaaaggcgagucaaggucuacaguca

SEQ ID NO: 291 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
caucaggccgaaaggcgagucaaggucuucccac

SEQ ID NO: 292 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
ucaucaggccgaaaggcgagucaaggucuucccaca

SEQ ID NO: 293 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
guuugggccgaaaggcgagucaaggucucccaaa

SEQ ID NO: 294 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gguuugggccgaaaggcgagucaaggucucccaaaa

SEQ ID NO: 295 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
uguagagccgaaaggcgagucaaggucuaucaau

SEQ ID NO: 296 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
auguagagccgaaaggcgagucaaggucuaucaaug

SEQ ID NO: 297 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
auccaagccgaaaggcgagucaaggucuauuuga

SEQ ID NO: 298 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cauccaagccgaaaggcgagucaaggucuauuugac

SEQ ID NO: 299 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
caccaagccgaaaggcgagucaaggucuucccgg

SEQ ID NO: 300 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
acaccaagccgaaaggcgagucaaggucuucccgga

SEQ ID NO: 301 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
agccaggccgaaaggcgagucaaggucucccuuc

SEQ ID NO: 302 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ucggaggccgaaaggcgagucaaggucucagccc

SEQ ID NO: 303 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
aucggaggccgaaaggcgagucaaggucucagcccc

SEQ ID NO: 304 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
aggucagccgaaaggcgagucaaggucucaucaa

SEQ ID NO: 305 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
caggucagccgaaaggcgagucaaggucucaucaaa

SEQ ID NO: 306 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
guaccggccgaaaggcgagucaaggucuuguaga

SEQ ID NO: 307 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
uguaccggccgaaaggcgagucaaggucuuguagag

SEQ ID NO: 308 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
gcaaaaagccgaaaggcgagucaaggucugucuuug

SEQ ID NO: 309 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
ugaagggccgaaaggcgagucaaggucuaggagg

SEQ ID NO: 310 - RNA, 36 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(15): 2'-O-Methyl
  misc_feature (19)..(19): 2'-O-Methyl
  misc_feature (21)..(24): 2'-O-Methyl
  misc_feature (27)..(27): 2'-O-Methyl
  misc_feature (29)..(36): 2'-O-Methyl
  misc_feature (17)..(17): 2'-deoxy-2'-amino
  misc_feature (28)..(28): 2'-deoxy-2'-amino
  misc_feature (36)..(36): 3'-end phosphate attached to an inverted deoxyabasic moiety, in a 3'-3 orientation
cugaagggccgaaaggcgagucaaggucuaggagga

SEQ ID NO: 311 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(6): 2'-O-Methyl
  misc_feature (8)..(14): 2'-O-Methyl
  misc_feature (18)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (34)..(34): 3'-end phosphate attached to an inverted deoxyabasic moiety, in a 3'-3 orientation
gucagggccgaaaggcgagucaaggucucuuccc

SEQ ID NO: 312 - RNA, 17 nt, Homo sapiens
gggcagccgcgcgcccc

SEQ ID NO: 313 - RNA, 17 nt, Homo sapiens
gcagccgcgcgccccuu

SEQ ID NO: 314 - RNA, 17 nt, Homo sapiens
agccgcgcgccccuucc

SEQ ID NO: 315 - RNA, 17 nt, Homo sapiens
ccuuuacugcgccgcgc

SEQ ID NO: 316 - RNA, 17 nt, Homo sapiens
uuuacugcgccgcgcgc

SEQ ID NO: 317 - RNA, 17 nt, Homo sapiens
acugcgccgcgcgcccg

SEQ ID NO: 318 - RNA, 17 nt, Homo sapiens
ugcgccgcgcgcccggc

SEQ ID NO: 319 - RNA, 17 nt, Homo sapiens
cgccgcgcgcccggccc

SEQ ID NO: 320 - RNA, 17 nt, Homo sapiens
caccccucgcagcaccc

SEQ ID NO: 321 - RNA, 17 nt, Homo sapiens
agcaccccgcgccccgc

SEQ ID NO: 322 - RNA, 17 nt, Homo sapiens
caccccgcgccccgcgc

SEQ ID NO: 323 - RNA, 17 nt, Homo sapiens
cgcgccccgcgcccucc

SEQ ID NO: 324 - RNA, 17 nt, Homo sapiens
cgccccgcgcccuccca

SEQ ID NO: 325 - RNA, 17 nt, Homo sapiens
ccggagccgcagugagc

SEQ ID NO: 326 - RNA, 17 nt, Homo sapiens
ggccuugugccgcuggg

SEQ ID NO: 327 - RNA, 17 nt, Homo sapiens
cuugugccgcugggggc

SEQ ID NO: 328 - RNA, 17 nt, Homo sapiens
uccuccucgcccucuug

SEQ ID NO: 329 - RNA, 17 nt, Homo sapiens
gcccucuugccccccgg

SEQ ID NO: 330 - RNA, 17 nt, Homo sapiens
ccggagccgcgagcacc

SEQ ID NO: 331 - RNA, 17 nt, Homo sapiens
ccaagugugcaccggca

SEQ ID NO: 332 - RNA, 17 nt, Homo sapiens
augaagcugcggcuccc

SEQ ID NO: 333 - RNA, 17 nt, Homo sapiens
ggcucccugccaguccc

SEQ ID NO: 334 - RNA, 17 nt, Homo sapiens
cuggacaugcuccgcca

SEQ ID NO: 335 - RNA, 17 nt, Homo sapiens
caugcuccgccaccucu

SEQ ID NO: 336 - RNA, 17 nt, Homo sapiens
ccagggcugccaggugg

SEQ ID NO: 337 - RNA, 17 nt, Homo sapiens
cagguggugcagggaaa

SEQ ID NO: 338 - RNA, 17 nt, Homo sapiens
accuaccugcccaccaa

SEQ ID NO: 339 - RNA, 17 nt, Homo sapiens
ccaccaaugccagccug

SEQ ID NO: 340 - RNA, 17 nt, Homo sapiens
uccuuccugcaggauau

SEQ ID NO: 341 - RNA, 17 nt, Homo sapiens
caggaggugcagggcua

SEQ ID NO: 342 - RNA, 17 nt, Homo sapiens
ggcuacgugcucaucgc

SEQ ID NO: 343 - RNA, 17 nt, Homo sapiens
ugcucaucgcucacaac

SEQ ID NO: 344 - RNA, 17 nt, Homo sapiens
gucccacugcagaggcu

SEQ ID NO: 345 - RNA, 17 nt, Homo sapiens
cagaggcugcggauugu

SEQ ID NO: 346 - RNA, 17 nt, Homo sapiens
cggauugugcgaggcac

SEQ ID NO: 347 - RNA, 17 nt, Homo sapiens
acaacuaugcccuggcc

SEQ ID NO: 348 - RNA, 17 nt, Homo sapiens
cuggccgugcuagacaa

SEQ ID NO: 349 - RNA, 17 nt, Homo sapiens
ggagacccgcugaacaa

SEQ ID NO: 350 - RNA, 17 nt, Homo sapiens
ggaggccugcgggagcu

SEQ ID NO: 351 - RNA, 17 nt, Homo sapiens
cgggagcugcagcuucg

SEQ ID NO: 352 - RNA, 17 nt, Homo sapiens
ccagcucugcuaccagg

SEQ ID NO: 353 - RNA, 17 nt, Homo sapiens
caccaaccgcucucggg

SEQ ID NO: 354 - RNA, 17 nt, Homo sapiens
ucgggccugccaccccu

SEQ ID NO: 355 - RNA, 17 nt, Homo sapiens
gggcucccgcugcuggg

SEQ ID NO: 356 - RNA, 17 nt, Homo sapiens
cucccgcugcuggggag

SEQ ID NO: 357 - RNA, 17 nt, Homo sapiens
agccugacgcgcacugu

SEQ ID NO: 358 - RNA, 17 nt, Homo sapiens
ccugacgcgcacugucu

SEQ ID NO: 359 - RNA, 17 nt, Homo sapiens
cugucugugccgguggc

SEQ ID NO: 360 - RNA, 17 nt, Homo sapiens
guggcugugcccgcugc

SEQ ID NO: 361 - RNA, 17 nt, Homo sapiens
cugugcccgcugcaagg

SEQ ID NO: 362 - RNA, 17 nt, Homo sapiens
ugcccgcugcaaggggc

SEQ ID NO: 363 - RNA, 17 nt, Homo sapiens
gggccacugcccacuga

SEQ ID NO: 364 - RNA, 17 nt, Homo sapiens
cacugacugcugccaug

SEQ ID NO: 365 - RNA, 17 nt, Homo sapiens
ugacugcugccaugagc

SEQ ID NO: 366 - RNA, 17 nt, Homo sapiens
agcagugugcugccggc

SEQ ID NO: 367 - RNA, 17 nt, Homo sapiens
agugugcugccggcugc

SEQ ID NO: 368 - RNA, 17 nt, Homo sapiens
ugccggcugcacgggcc

SEQ ID NO: 369 - RNA, 17 nt, Homo sapiens
cucugacugccuggccu

SEQ ID NO: 370 - RNA, 17 nt, Homo sapiens
ccuggccugccuccacu

SEQ ID NO: 371 - RNA, 17 nt, Homo sapiens
ugugagcugcacugccc

SEQ ID NO: 372 - RNA, 17 nt, Homo sapiens
gcugcacugcccagccc

SEQ ID NO: 373 - RNA, 17 nt, Homo sapiens
gaguccaugcccaaucc

SEQ ID NO: 374 - RNA, 17 nt, Homo sapiens
cauucggcgccagcugu

SEQ ID NO: 375 - RNA, 17 nt, Homo sapiens
gugugacugccuguccc

SEQ ID NO: 376 - RNA, 17 nt, Homo sapiens
gggauccugcacccucg

SEQ ID NO: 377 - RNA, 17 nt, Homo sapiens
ccucgucugcccccugc

SEQ ID NO: 378 - RNA, 17 nt, Homo sapiens
ugcccccugcacaacca

SEQ ID NO: 379 - RNA, 17 nt, Homo sapiens
ugagaagugcagcaagc

SEQ ID NO: 380 - RNA, 17 nt, Homo sapiens
agcccugugcccgagug

SEQ ID NO: 381 - RNA, 17 nt, Homo sapiens
ccgagugugcuaugguc

SEQ ID NO: 382 - RNA, 17 nt, Homo sapiens
gagcacuugcgagaggu

SEQ ID NO: 383 - RNA, 17 nt, Homo sapiens
uuaccagugccaauauc

SEQ ID NO: 384 - RNA, 17 nt, Homo sapiens
aggaguuugcuggcugc

SEQ ID NO: 385 - RNA, 17 nt, Homo sapiens
ugcuggcugcaagaaga

SEQ ID NO: 386 - RNA, 17 nt, Homo sapiens
gcauuucugccggagag

SEQ ID NO: 387 - RNA, 17 nt, Homo sapiens
ccaacacugccccgcuc

SEQ ID NO: 388 - RNA, 17 nt, Homo sapiens
acugccccgcuccagcc

SEQ ID NO: 389 - RNA, 17 nt, Homo sapiens
gacagccugccugaccu

SEQ ID NO: 390 - RNA, 17 nt, Homo sapiens
cagaaccugcaaguaau

SEQ ID NO: 391 - RNA, 17 nt, Homo sapiens
cgaauucugcacaaugg

SEQ ID NO: 392 - RNA, 17 nt, Homo sapiens
acaauggcgccuacucg

SEQ ID NO: 393 - RNA, 17 nt, Homo sapiens
gccuacucgcugacccu

SEQ ID NO: 394 - RNA, 17 nt, Homo sapiens
cugacccugcaagggcu

SEQ ID NO: 395 - RNA, 17 nt, Homo sapiens
cuggggcugcgcucacu

SEQ ID NO: 396 - RNA, 17 nt, Homo sapiens
ggggcugcgcucacuga

SEQ ID NO: 397 - RNA, 17 nt, Homo sapiens
ccaccucugcuucgugc

SEQ ID NO: 398 - RNA, 17 nt, Homo sapiens
ugcuucgugcacacggu

SEQ ID NO: 399 - RNA, 17 nt, Homo sapiens
cacacggugcccuggga

SEQ ID NO: 400 - RNA, 17 nt, Homo sapiens
cggaacccgcaccaagc

SEQ ID NO: 401 - RNA, 17 nt, Homo sapiens
caagcucugcuccacac

SEQ ID NO: 402 - RNA, 17 nt, Homo sapiens
uccacacugccaaccgg

SEQ ID NO: 403 - RNA, 17 nt, Homo sapiens
ccuggccugccaccagc

SEQ ID NO: 404 - RNA, 17 nt, Homo sapiens
ccagcugugcgcccgag

SEQ ID NO: 405 - RNA, 17 nt, Homo sapiens
agcugugcgcccgaggg

SEQ ID NO: 406 - RNA, 17 nt, Homo sapiens
agggcacugcugggguc

SEQ ID NO: 407 - RNA, 17 nt, Homo sapiens
ugucaacugcagccagu

SEQ ID NO: 408 - RNA, 17 nt, Homo sapiens
ccaggagugcguggagg

SEQ ID NO: 409 - RNA, 17 nt, Homo sapiens
ggaggaaugccgaguac

SEQ ID NO: 410 - RNA, 17 nt, Homo sapiens
cgaguacugcaggggcu

SEQ ID NO: 411 - RNA, 17 nt, Homo sapiens
augugaaugccaggcac

SEQ ID NO: 412 - RNA, 17 nt, Homo sapiens
cacuguuugccgugcca

SEQ ID NO: 413 - RNA, 17 nt, Homo sapiens
uuugccgugccacccug

SEQ ID NO: 414 - RNA, 17 nt, Homo sapiens
uggccugugcccacuau

SEQ ID NO: 415 - RNA, 17 nt, Homo sapiens
ucccuucugcguggccc

SEQ ID NO: 416 - RNA, 17 nt, Homo sapiens
cguggcccgcugcccca

SEQ ID NO: 417 - RNA, 17 nt, Homo sapiens
ggcccgcugccccagcg

SEQ ID NO: 418 - RNA, 17 nt, Homo sapiens
uccuacaugcccaucug

SEQ ID NO: 419 - RNA, 17 nt, Homo sapiens
aggagggcgcaugccag

SEQ ID NO: 420 - RNA, 17 nt, Homo sapiens
gggcgcaugccagccuu

SEQ ID NO: 421 - RNA, 17 nt, Homo sapiens
ccagccuugccccauca

SEQ ID NO: 422 - RNA, 17 nt, Homo sapiens
caucaacugcacccacu

SEQ ID NO: 423 - RNA, 17 nt, Homo sapiens
caagggcugccccgccg

SEQ ID NO: 424 - RNA, 17 nt, Homo sapiens
gcugccccgccgagcag

SEQ ID NO: 425 - RNA, 17 nt, Homo sapiens
ucaucucugcggugguu

SEQ ID NO: 426 - RNA, 17 nt, Homo sapiens
ggcauucugcuggucgu

SEQ ID NO: 427 - RNA, 17 nt, Homo sapiens
uacacgaugcggagacu

SEQ ID NO: 428 - RNA, 17 nt, Homo sapiens
cggagacugcugcagga

SEQ ID NO: 429 - RNA, 17 nt, Homo sapiens
agacugcugcaggaaac

SEQ ID NO: 430 - RNA, 17 nt, Homo sapiens
guggagccgcugacacc

SEQ ID NO: 431 - RNA, 17 nt, Homo sapiens
ggagcgaugcccaacca

SEQ ID NO: 432 - RNA, 17 nt, Homo sapiens
aaccaggcgcagaugcg

SEQ ID NO: 433 - RNA, 17 nt, Homo sapiens
gcgcagaugcggauccu

SEQ ID NO: 434 - RNA, 17 nt, Homo sapiens
gugaaggugcuuggauc

SEQ ID NO: 435 - RNA, 17 nt, Homo sapiens
gaucuggcgcuuuuggc

SEQ ID NO: 436 - RNA, 17 nt, Homo sapiens
ugucucccgccuucugg

SEQ ID NO: 437 - RNA, 17 nt, Homo sapiens
gggcaucugccugacau

SEQ ID NO: 438 - RNA, 17 nt, Homo sapiens
uccacggugcagcuggu

SEQ ID NO: 439 - RNA, 17 nt, Homo sapiens
cagcuuaugcccuaugg

SEQ ID NO: 440 - RNA, 17 nt, Homo sapiens
cuauggcugccucuuag

SEQ ID NO: 441 - RNA, 17 nt, Homo sapiens
ggaaaaccgcggacgcc

SEQ ID NO: 442 - RNA, 17 nt, Homo sapiens
ccgcggacgccugggcu

SEQ ID NO: 443 - RNA, 17 nt, Homo sapiens
caggaccugcugaacug

SEQ ID NO: 444 - RNA, 17 nt, Homo sapiens
ugguguaugcagauugc

SEQ ID NO: 445 - RNA, 17 nt, Homo sapiens
ugcagauugccaagggg

SEQ ID NO: 446 - RNA, 17 nt, Homo sapiens
gaggaugugcggcucgu

SEQ ID NO: 447 - RNA, 17 nt, Homo sapiens
acuuggccgcucggaac

SEQ ID NO: 448 - RNA, 17 nt, Homo sapiens
cggaacgugcuggucaa

SEQ ID NO: 449 - RNA, 17 nt, Homo sapiens
gcucggcugcuggacau

SEQ ID NO: 450 - RNA, 17 nt, Homo sapiens
aguaccaugcagauggg

SEQ ID NO: 451 - RNA, 17 nt, Homo sapiens
ggcaaggugcccaucaa

SEQ ID NO: 452 - RNA, 17 nt, Homo sapiens
uggauggcgcuggaguc

SEQ ID NO: 453 - RNA, 17 nt, Homo sapiens
cauucuccgccggcggu

SEQ ID NO: 454 - RNA, 17 nt, Homo sapiens
ccugaccugcuggaaaa

SEQ ID NO: 455 - RNA, 17 nt, Homo sapiens
gagcggcugccccagcc

SEQ ID NO: 456 - RNA, 17 nt, Homo sapiens
ccccaucugcaccauug

SEQ ID NO: 457 - RNA, 17 nt, Homo sapiens
auucucccgcauggcca

SEQ ID NO: 458 - RNA, 17 nt, Homo sapiens
cccccagcgcuuugugg

SEQ ID NO: 459 - RNA, 17 nt, Homo sapiens
cuucuaccgcucacugc

SEQ ID NO: 460 - RNA, 17 nt, Homo sapiens
cgcucacugcuggagga

SEQ ID NO: 461 - RNA, 17 nt, Homo sapiens
ugguggaugcugaggag

SEQ ID NO: 462 - RNA, 17 nt, Homo sapiens
cagacccugccccgggc

SEQ ID NO: 463 - RNA, 17 nt, Homo sapiens
ccccgggcgcugggggc

SEQ ID NO: 464 - RNA, 17 nt, Homo sapiens
caggcaccgcagcucau

SEQ ID NO: 465 - RNA, 17 nt, Homo sapiens
aaggggcugcaaagccu

SEQ ID NO: 466 - RNA, 17 nt, Homo sapiens
guaccccugcccucuga

SEQ ID NO: 467 - RNA, 17 nt, Homo sapiens
gcuacguugccccccug

SEQ ID NO: 468 - RNA, 17 nt, Homo sapiens
ccugaccugcagccccc

SEQ ID NO: 469 - RNA, 17 nt, Homo sapiens
cccccuucgccccgaga

SEQ ID NO: 470 - RNA, 17 nt, Homo sapiens
ggcccucugccugcugc

SEQ ID NO: 471 - RNA, 17 nt, Homo sapiens
cucugccugcugcccga

SEQ ID NO: 472 - RNA, 17 nt, Homo sapiens
ugccugcugcccgaccu

SEQ ID NO: 473 - RNA, 17 nt, Homo sapiens
cccgaccugcuggugcc

SEQ ID NO: 474 - RNA, 17 nt, Homo sapiens
cugcuggugccacucug

SEQ ID NO: 475 - RNA, 17 nt, Homo sapiens
acguuuuugccuuuggg

SEQ ID NO: 476 - RNA, 17 nt, Homo sapiens
uugggggugccguggag

SEQ ID NO: 477 - RNA, 17 nt, Homo sapiens
gaggagcugccccucag

SEQ ID NO: 478 - RNA, 17 nt, Homo sapiens
cuccuccugccuucagc

SEQ ID NO: 479 - RNA, 17 nt, Homo sapiens
cuggacgugccagugug

SEQ ID NO: 480 - RNA, 17 nt, Homo sapiens
ccaaguccgcagaagcc

SEQ ID NO: 481 - RNA, 17 nt, Homo sapiens
ugacuucugcuggcauc

SEQ ID NO: 482 - RNA, 17 nt, Homo sapiens
gggaaccugccaugcca

SEQ ID NO: 483 - RNA, 17 nt, Homo sapiens
ccugccaugccaggaac

SEQ ID NO: 484 - RNA, 17 nt, Homo sapiens
uccuuccugcuugaguu

SEQ ID NO: 485 - RNA, 17 nt, Homo sapiens
gaggcccugcccaauga

SEQ ID NO: 486 - RNA, 17 nt, Homo sapiens
caguggaugccacagcc

SEQ ID NO: 487 - RNA, 17 nt, Homo sapiens
cuaguacugccccccau

SEQ ID NO: 488 - RNA, 17 nt, Homo sapiens
uacagagugcuuuucug

SEQ ID NO: 489 - RNA, 17 nt, Homo sapiens
gcggccuugugccgcug

SEQ ID NO: 490 - RNA, 17 nt, Homo sapiens
acccaagugugcaccgg

SEQ ID NO: 491 - RNA, 17 nt, Homo sapiens
gccagccuguccuuccu

SEQ ID NO: 492 - RNA, 17 nt, Homo sapiens
ugcggauugugcgaggc

SEQ ID NO: 493 - RNA, 17 nt, Homo sapiens
ccaccccugucacaggg

SEQ ID NO: 494 - RNA, 17 nt, Homo sapiens
acgauuuuguggaagga

SEQ ID NO: 495 - RNA, 17 nt, Homo sapiens
ccaccccuguucuccga

SEQ ID NO: 496 - RNA, 17 nt, Homo sapiens
ucuccgauguguaaggg

SEQ ID NO: 497 - RNA, 17 nt, Homo sapiens
uccgauguguaagggcu

SEQ ID NO: 498 - RNA, 17 nt, Homo sapiens
ugaggauugucagagcc

SEQ ID NO: 499 - RNA, 17 nt, Homo sapiens
cgcgcacugucugugcc

SEQ ID NO: 500 - RNA, 17 nt, Homo sapiens
cacugucugugccggug

SEQ ID NO: 501 - RNA, 17 nt, Homo sapiens
cgguggcugugcccgcu

SEQ ID NO: 502 - RNA, 17 nt, Homo sapiens
ugagcagugugcugccg

SEQ ID NO: 503 - RNA, 17 nt, Homo sapiens
uggcaucugugagcugc

SEQ ID NO: 504 - RNA, 17 nt, Homo sapiens
cgccagcugugugacug

SEQ ID NO: 505 - RNA, 17 nt, Homo sapiens
ccagcugugugacugcc

SEQ ID NO: 506 - RNA, 17 nt, Homo sapiens
gacugccugucccuaca

SEQ ID NO: 507 - RNA, 17 nt, Homo sapiens
acagcggugugagaagu

SEQ ID NO: 508 - RNA, 17 nt, Homo sapiens
caagcccugugcccgag

SEQ ID NO: 509 - RNA, 17 nt, Homo sapiens
gcccgagugugcuaugg

SEQ ID NO: 510 - RNA, 17 nt, Homo sapiens
cuccaaguguuugagac

SEQ ID NO: 511 - RNA, 17 nt, Homo sapiens
ggacgagugugugggcg

SEQ ID NO: 512 - RNA, 17 nt, Homo sapiens
acgagugugugggcgag

SEQ ID NO: 513 - RNA, 17 nt, Homo sapiens
caccagcugugcgcccg

SEQ ID NO: 514 - RNA, 17 nt, Homo sapiens
cacccagugugucaacu

SEQ ID NO: 515 - RNA, 17 nt, Homo sapiens
cccagugugucaacugc

SEQ ID NO: 516 - RNA, 17 nt, Homo sapiens
gggaguaugugaaugcc

SEQ ID NO: 517 - RNA, 17 nt, Homo sapiens
caggcacuguuugccgu

SEQ ID NO: 518 - RNA, 17 nt, Homo sapiens
cccugagugucagcccc

SEQ ID NO: 519 - RNA, 17 nt, Homo sapiens
agugaccuguuuuggac

SEQ ID NO: 520 - RNA, 17 nt, Homo sapiens
ugaccaguguguggccu

SEQ ID NO: 521 - RNA, 17 nt, Homo sapiens
accaguguguggccugu

SEQ ID NO: 522 - RNA, 17 nt, Homo sapiens
uguggccugugcccacu

SEQ ID NO: 523 - RNA, 17 nt, Homo sapiens
ccagcggugugaaaccu

SEQ ID NO: 524 - RNA, 17 nt, Homo sapiens
ccacuccuguguggacc

SEQ ID NO: 525 - RNA, 17 nt, Homo sapiens
acuccuguguggaccug

SEQ ID NO: 526 - RNA, 17 nt, Homo sapiens
gggagaaugugaaaauu

SEQ ID NO: 527 - RNA, 17 nt, Homo sapiens
aucaaaguguugaggga

SEQ ID NO: 528 - RNA, 17 nt, Homo sapiens
uggcuggugugggcucc

SEQ ID NO: 529 - RNA, 17 nt, Homo sapiens
ccccauaugucucccgc

SEQ ID NO: 530 - RNA, 17 nt, Homo sapiens
uagaccauguccgggaa

SEQ ID NO: 531 - RNA, 17 nt, Homo sapiens
gaacugguguaugcaga

SEQ ID NO: 532 - RNA, 17 nt, Homo sapiens
uggaggaugugcggcuc

SEQ ID NO: 533 - RNA, 17 nt, Homo sapiens
ccaaccaugucaaaauu

SEQ ID NO: 534 - RNA, 17 nt, Homo sapiens
agagugauguguggagu

SEQ ID NO: 535 - RNA, 17 nt, Homo sapiens
agugauguguggaguua

SEQ ID NO: 536 - RNA, 17 nt, Homo sapiens
guuauggugugacugug

SEQ ID NO: 537 - RNA, 17 nt, Homo sapiens
gugugacugugugggag

SEQ ID NO: 538 - RNA, 17 nt, Homo sapiens
gugacugugugggagcu

SEQ ID NO: 539 - RNA, 17 nt, Homo sapiens
ccauugaugucuacaug

SEQ ID NO: 540 - RNA, 17 nt, Homo sapiens
ggucaaauguuggauga

SEQ ID NO: 541 - RNA, 17 nt, Homo sapiens
cucugaaugucggccaa

SEQ ID NO: 542 - RNA, 17 nt, Homo sapiens
gaguuggugucugaauu

SEQ ID NO: 543 - RNA, 17 nt, Homo sapiens
agcgcuuuguggucauc

SEQ ID NO: 544 - RNA, 17 nt, Homo sapiens
cuucuucuguccagacc

SEQ ID NO: 545 - RNA, 17 nt, Homo sapiens
gcuccgauguauuugau

SEQ ID NO: 546 - RNA, 17 nt, Homo sapiens
cugaauaugugaaccag

SEQ ID NO: 547 - RNA, 17 nt, Homo sapiens
agccagauguucggccc

SEQ ID NO: 548 - RNA, 17 nt, Homo sapiens
gugccagugugaaccag

SEQ ID NO: 549 - RNA, 17 nt, Homo sapiens
gcccugauguguccuca

SEQ ID NO: 550 - RNA, 17 nt, Homo sapiens
ccugauguguccucagg

SEQ ID NO: 551 - RNA, 17 nt, Homo sapiens
aggaaccuguccuaagg

SEQ ID NO: 552 - RNA, 17 nt, Homo sapiens
gagucuuuguggauucu

SEQ ID NO: 553 - RNA, 17 nt, Homo sapiens
aagggagugucuaagaa

SEQ ID NO: 554 - RNA, 17 nt, Homo sapiens
cagagacugucccugaa

SEQ ID NO: 555 - RNA, 17 nt, Homo sapiens
gcaauggugucaguauc

SEQ ID NO: 556 - RNA, 17 nt, Homo sapiens
caggcuuuguacagagu

SEQ ID NO: 557 - RNA, 17 nt, Homo sapiens
gcuuuucuguuuaguuu

SEQ ID NO: 558 - RNA, 17 nt, Homo sapiens
cuuuuuuuguuuuguuu

SEQ ID NO: 559 - RNA, 17 nt, Homo sapiens
uuuguuuuguuuuuuua

SEQ ID NO: 560 - RNA, 17 nt, Homo sapiens
aaggggagguaacccug

SEQ ID NO: 561 - RNA, 17 nt, Homo sapiens
uaacccuggccccuuug

SEQ ID NO: 562 - RNA, 17 nt, Homo sapiens
ccccuuuggucggggcc

SEQ ID NO: 563 - RNA, 17 nt, Homo sapiens
uggucggggccccgggc

SEQ ID NO: 564 - RNA, 17 nt, Homo sapiens
ggccccgggcagccgcg

SEQ ID NO: 565 - RNA, 17 nt, Homo sapiens
cccgggcagccgcgcgc

SEQ ID NO: 566 - RNA, 17 nt, Homo sapiens
cccacggggcccuuuac

SEQ ID NO: 567 - RNA, 17 nt, Homo sapiens
cgcgcccggcccccacc

SEQ ID NO: 568 - RNA, 17 nt, Homo sapiens
cccucgcagcaccccgc

SEQ ID NO: 569 - RNA, 17 nt, Homo sapiens
cccucccagccgggucc

SEQ ID NO: 570 - RNA, 17 nt, Homo sapiens
ccagccggguccagccg

SEQ ID NO: 571 - RNA, 17 nt, Homo sapiens
cggguccagccggagcc

SEQ ID NO: 572 - RNA, 17 nt, Homo sapiens
cagccggagccaugggg

SEQ ID NO: 573 - RNA, 17 nt, Homo sapiens
gccauggggccggagcc

SEQ ID NO: 574 - RNA, 17 nt, Homo sapiens
gggccggagccgcagug

SEQ ID NO: 575 - RNA, 17 nt, Homo sapiens
gagccgcagugagcacc

SEQ ID NO: 576 - RNA, 17 nt, Homo sapiens
cgcagugagcaccaugg

SEQ ID NO: 577 - RNA, 17 nt, Homo sapiens
accauggagcuggcggc

SEQ ID NO: 578 - RNA, 17 nt, Homo sapiens
uggagcuggcggccuug

SEQ ID NO: 579 - RNA, 17 nt, Homo sapiens
agcuggcggccuugugc

SEQ ID NO: 580 - RNA, 17 nt, Homo sapiens
cgcugggggcuccuccu

SEQ ID NO: 581 - RNA, 17 nt, Homo sapiens
cccccggagccgcgagc

SEQ ID NO: 582 - RNA, 17 nt, Homo sapiens
agccgcgagcacccaag

SEQ ID NO: 583 - RNA, 17 nt, Homo sapiens
gcacccaagugugcacc

SEQ ID NO: 584 - RNA, 17 nt, Homo sapiens
gugcaccggcacagaca

SEQ ID NO: 585 - RNA, 17 nt, Homo sapiens
gacaugaagcugcggcu

SEQ ID NO: 586 - RNA, 17 nt, Homo sapiens
aagcugcggcucccugc

SEQ ID NO: 587 - RNA, 17 nt, Homo sapiens
cccugccagucccgaga

SEQ ID NO: 588 - RNA, 17 nt, Homo sapiens
cuaccagggcugccagg

SEQ ID NO: 589 - RNA, 17 nt, Homo sapiens
gcugccagguggugcag

SEQ ID NO: 590 - RNA, 17 nt, Homo sapiens
gccagguggugcaggga

SEQ ID NO: 591 - RNA, 17 nt, Homo sapiens
caaugccagccuguccu

SEQ ID NO: 592 - RNA, 17 nt, Homo sapiens
uccaggaggugcagggc

SEQ ID NO: 593 - RNA, 17 nt, Homo sapiens
ggugcagggcuacgugc

SEQ ID NO: 594 - RNA, 17 nt, Homo sapiens
agggcuacgugcucauc

SEQ ID NO: 595 - RNA, 17 nt, Homo sapiens
acaaccaagugaggcag

SEQ ID NO: 596 - RNA, 17 nt, Homo sapiens
caagugaggcagguccc

SEQ ID NO: 597 - RNA, 17 nt, Homo sapiens
ugaggcaggucccacug

SEQ ID NO: 598 - RNA, 17 nt, Homo sapiens
cugcagaggcugcggau

SEQ ID NO: 599 - RNA, 17 nt, Homo sapiens
ugugcgaggcacccagc

SEQ ID NO: 600 - RNA, 17 nt, Homo sapiens
ggcacccagcucuuuga

SEQ ID NO: 601 - RNA, 17 nt, Homo sapiens
augcccuggccgugcua

SEQ ID NO: 602 - RNA, 17 nt, Homo sapiens
cccuggccgugcuagac

SEQ ID NO: 603 - RNA, 17 nt, Homo sapiens
ucacaggggccucccca

SEQ ID NO: 604 - RNA, 17 nt, Homo sapiens
cccaggaggccugcggg

SEQ ID NO: 605 - RNA, 17 nt, Homo sapiens
cugcgggagcugcagcu

SEQ ID NO: 606 - RNA, 17 nt, Homo sapiens
gagcugcagcuucgaag

SEQ ID NO: 607 - RNA, 17 nt, Homo sapiens
gcuucgaagccucacag

SEQ ID NO: 608 - RNA, 17 nt, Homo sapiens
aaggaggggucuugauc

SEQ ID NO: 609 - RNA, 17 nt, Homo sapiens
uugauccagcggaaccc

SEQ ID NO: 610 - RNA, 17 nt, Homo sapiens
aacccccagcucugcua

SEQ ID NO: 611 - RNA, 17 nt, Homo sapiens
aacaaccagcuggcucu

SEQ ID NO: 612 - RNA, 17 nt, Homo sapiens
accagcuggcucucaca

SEQ ID NO: 613 - RNA, 17 nt, Homo sapiens
gcucucgggccugccac

SEQ ID NO: 614 - RNA, 17 nt, Homo sapiens
guguaagggcucccgcu

SEQ ID NO: 615 - RNA, 17 nt, Homo sapiens
gggagagaguucugagg

SEQ ID NO: 616 - RNA, 17 nt, Homo sapiens
uugucagagccugacgc

SEQ ID NO: 617 - RNA, 17 nt, Homo sapiens
cugugccgguggcugug

SEQ ID NO: 618 - RNA, 17 nt, Homo sapiens
ugccgguggcugugccc

SEQ ID NO: 619 - RNA, 17 nt, Homo sapiens
ugcaaggggccacugcc

SEQ ID NO: 620 - RNA, 17 nt, Homo sapiens
ugccaugagcagugugc

SEQ ID NO: 621 - RNA, 17 nt, Homo sapiens
caugagcagugugcugc

SEQ ID NO: 622 - RNA, 17 nt, Homo sapiens
ugcugccggcugcacgg

SEQ ID NO: 623 - RNA, 17 nt, Homo sapiens
cugcacgggccccaagc

SEQ ID NO: 624 - RNA, 17 nt, Homo sapiens
ggccccaagcacucuga

SEQ ID NO: 625 - RNA, 17 nt, Homo sapiens
acugccuggccugccuc

SEQ ID NO: 626 - RNA, 17 nt, Homo sapiens
caaccacaguggcaucu

SEQ ID NO: 627 - RNA, 17 nt, Homo sapiens
ccacaguggcaucugug

SEQ ID NO: 628 - RNA, 17 nt, Homo sapiens
aucugugagcugcacug

SEQ ID NO: 629 - RNA, 17 nt, Homo sapiens
acugcccagcccugguc

SEQ ID NO: 630 - RNA, 17 nt, Homo sapiens
cagcccuggucaccuac

SEQ ID NO: 631 - RNA, 17 nt, Homo sapiens
acagacacguuugaguc

SEQ ID NO: 632 - RNA, 17 nt, Homo sapiens
acguuugaguccaugcc

SEQ ID NO: 633 - RNA, 17 nt, Homo sapiens
ucccgagggccgguaua

SEQ ID NO: 634 - RNA, 17 nt, Homo sapiens
gagggccgguauacauu

SEQ ID NO: 635 - RNA, 17 nt, Homo sapiens
uacauucggcgccagcu

SEQ ID NO: 636 - RNA, 17 nt, Homo sapiens
cggcgccagcuguguga

SEQ ID NO: 637 - RNA, 17 nt, Homo sapiens
cuacggacgugggaucc

SEQ ID NO: 638 - RNA, 17 nt, Homo sapiens
gcacccucgucugcccc

SEQ ID NO: 639 - RNA, 17 nt, Homo sapiens
accaagaggugacagca

SEQ ID NO: 640 - RNA, 17 nt, Homo sapiens
aggugacagcagaggau

SEQ ID NO: 641 - RNA, 17 nt, Homo sapiens
ggaacacagcgguguga

SEQ ID NO: 642 - RNA, 17 nt, Homo sapiens
acacagcggugugagaa

SEQ ID NO: 643 - RNA, 17 nt, Homo sapiens
ugugagaagugcagcaa

SEQ ID NO: 644 - RNA, 17 nt, Homo sapiens
gaagugcagcaagcccu

SEQ ID NO: 645 - RNA, 17 nt, Homo sapiens
ugcagcaagcccugugc

SEQ ID NO: 646 - RNA, 17 nt, Homo sapiens
gugcccgagugugcuau

SEQ ID NO: 647 - RNA, 17 nt, Homo sapiens
gugcuauggucugggca

SEQ ID NO: 648 - RNA, 17 nt, Homo sapiens
uggucugggcauggagc

SEQ ID NO: 649 - RNA, 17 nt, Homo sapiens
ggcauggagcacuugcg

SEQ ID NO: 650 - RNA, 17 nt, Homo sapiens
ugcgagaggugagggca

SEQ ID NO: 651 - RNA, 17 nt, Homo sapiens
aggugagggcaguuacc

SEQ ID NO: 652 - RNA, 17 nt, Homo sapiens
ugagggcaguuaccagu

SEQ ID NO: 653 - RNA, 17 nt, Homo sapiens
aguuaccagugccaaua

SEQ ID NO: 654 - RNA, 17 nt, Homo sapiens
auccaggaguuugcugg

SEQ ID NO: 655 - RNA, 17 nt, Homo sapiens
guuugcuggcugcaaga

SEQ ID NO: 656 - RNA, 17 nt, Homo sapiens
cuuugggagccuggcau

SEQ ID NO: 657 - RNA, 17 nt, Homo sapiens
ggagccuggcauuucug

SEQ ID NO: 658 - RNA, 17 nt, Homo sapiens
gccggagagcuuugaug

SEQ ID NO: 659 - RNA, 17 nt, Homo sapiens
gggacccagccuccaac

SEQ ID NO: 660 - RNA, 17 nt, Homo sapiens
ccgcuccagccagagca

SEQ ID NO: 661 - RNA, 17 nt, Homo sapiens
cagccagagcagcucca

SEQ ID NO: 662 - RNA, 17 nt, Homo sapiens
ccagagcagcuccaagu

SEQ ID NO: 663 - RNA, 17 nt, Homo sapiens
agcuccaaguguuugag

SEQ ID NO: 664 - RNA, 17 nt, Homo sapiens
gaucacagguuaccuau

SEQ ID NO: 665 - RNA, 17 nt, Homo sapiens
acaucucagcauggccg

SEQ ID NO: 666 - RNA, 17 nt, Homo sapiens
ucagcauggccggacag

SEQ ID NO: 667 - RNA, 17 nt, Homo sapiens
gccggacagccugccug

SEQ ID NO: 668 - RNA, 17 nt, Homo sapiens
ugaccucagcgucuucc

SEQ ID NO: 669 - RNA, 17 nt, Homo sapiens
accucagcgucuuccag

SEQ ID NO: 670 - RNA, 17 nt, Homo sapiens
accugcaaguaauccgg

SEQ ID NO: 671 - RNA, 17 nt, Homo sapiens
gcacaauggcgccuacu

SEQ ID NO: 672 - RNA, 17 nt, Homo sapiens
cugcaagggcugggcau

SEQ ID NO: 673 - RNA, 17 nt, Homo sapiens
agggcugggcaucagcu

SEQ ID NO: 674 - RNA, 17 nt, Homo sapiens
gggcaucagcuggcugg

SEQ ID NO: 675 - RNA, 17 nt, Homo sapiens
aucagcuggcuggggcu

SEQ ID NO: 676 - RNA, 17 nt, Homo sapiens
uggcuggggcugcgcuc

SEQ ID NO: 677 - RNA, 17 nt, Homo sapiens
ggaacugggcaguggac

SEQ ID NO: 678 - RNA, 17 nt, Homo sapiens
acugggcaguggacugg

SEQ ID NO: 679 - RNA, 17 nt, Homo sapiens
guggacuggcccucauc

SEQ ID NO: 680 - RNA, 17 nt, Homo sapiens
ucugcuucgugcacacg

SEQ ID NO: 681 - RNA, 17 nt, Homo sapiens
ugcacacggugcccugg

SEQ ID NO: 682 - RNA, 17 nt, Homo sapiens
ugggaccagcucuuucg

SEQ ID NO: 683 - RNA, 17 nt, Homo sapiens
cgcaccaagcucugcuc

SEQ ID NO: 684 - RNA, 17 nt, Homo sapiens
gccaaccggccagagga

SEQ ID NO: 685 - RNA, 17 nt, Homo sapiens
gaggacgaguguguggg

SEQ ID NO: 686 - RNA, 17 nt, Homo sapiens
gugugugggcgagggcc

SEQ ID NO: 687 - RNA, 17 nt, Homo sapiens
gggcgagggccuggccu

SEQ ID NO: 688 - RNA, 17 nt, Homo sapiens
agggccuggccugccac

SEQ ID NO: 689 - RNA, 17 nt, Homo sapiens
ugccaccagcugugcgc

SEQ ID NO: 690 - RNA, 17 nt, Homo sapiens
gcccgagggcacugcug

SEQ ID NO: 691 - RNA, 17 nt, Homo sapiens
cugcugggguccagggc

SEQ ID NO: 692 - RNA, 17 nt, Homo sapiens
gguccagggcccaccca

SEQ ID NO: 693 - RNA, 17 nt, Homo sapiens
cccacccagugugucaa

SEQ ID NO: 694 - RNA, 17 nt, Homo sapiens
caacugcagccaguucc

SEQ ID NO: 695 - RNA, 17 nt, Homo sapiens
ugcagccaguuccuucg

SEQ ID NO: 696 - RNA, 17 nt, Homo sapiens
ccuucggggccaggagu

SEQ ID NO: 697 - RNA, 17 nt, Homo sapiens
ggccaggagugcgugga

SEQ ID NO: 698 - RNA, 17 nt, Homo sapiens
aggagugcguggaggaa

SEQ ID NO: 699 - RNA, 17 nt, Homo sapiens
aaugccgaguacugcag

SEQ ID NO: 700 - RNA, 17 nt, Homo sapiens
cugcaggggcuccccag

SEQ ID NO: 701 - RNA, 17 nt, Homo sapiens
cccagggaguaugugaa

SEQ ID NO: 702 - RNA, 17 nt, Homo sapiens
aaugccaggcacuguuu

SEQ ID NO: 703 - RNA, 17 nt, Homo sapiens
uguuugccgugccaccc

SEQ ID NO: 704 - RNA, 17 nt, Homo sapiens
cacccugagugucagcc

SEQ ID NO: 705 - RNA, 17 nt, Homo sapiens
gagugucagccccagaa

SEQ ID NO: 706 - RNA, 17 nt, Homo sapiens
ccagaauggcucaguga

SEQ ID NO: 707 - RNA, 17 nt, Homo sapiens
auggcucagugaccugu

SEQ ID NO: 708 - RNA, 17 nt, Homo sapiens
gaccggaggcugaccag

SEQ ID NO: 709 - RNA, 17 nt, Homo sapiens
gcugaccaguguguggc

SEQ ID NO: 710 - RNA, 17 nt, Homo sapiens
aguguguggccugugcc

SEQ ID NO: 711 - RNA, 17 nt, Homo sapiens
ccuucugcguggcccgc

SEQ ID NO: 712 - RNA, 17 nt, Homo sapiens
ucugcguggcccgcugc

SEQ ID NO: 713 - RNA, 17 nt, Homo sapiens
cugccccagcgguguga

SEQ ID NO: 714 - RNA, 17 nt, Homo sapiens
ccccagcggugugaaac

SEQ ID NO: 715 - RNA, 17 nt, Homo sapiens
aucuggaaguuuccaga

SEQ ID NO: 716 - RNA, 17 nt, Homo sapiens
ugaggagggcgcaugcc

SEQ ID NO: 717 - RNA, 17 nt, Homo sapiens
gcaugccagccuugccc

SEQ ID NO: 718 - RNA, 17 nt, Homo sapiens
ugacaagggcugccccg

SEQ ID NO: 719 - RNA, 17 nt, Homo sapiens
cccgccgagcagagagc

SEQ ID NO: 720 - RNA, 17 nt, Homo sapiens
agcagagagccagcccu

SEQ ID NO: 721 - RNA, 17 nt, Homo sapiens
gagagccagcccucuga

SEQ ID NO: 722 - RNA, 17 nt, Homo sapiens
ccucugacguccaucau

SEQ ID NO: 723 - RNA, 17 nt, Homo sapiens
ucucugcggugguuggc

SEQ ID NO: 724 - RNA, 17 nt, Homo sapiens
cugcggugguuggcauu

SEQ ID NO: 725 - RNA, 17 nt, Homo sapiens
ggugguuggcauucugc

SEQ ID NO: 726 - RNA, 17 nt, Homo sapiens
uucugcuggucgugguc

SEQ ID NO: 727 - RNA, 17 nt, Homo sapiens
ugcuggucguggucuug

SEQ ID NO: 728 - RNA, 17 nt, Homo sapiens
uggucguggucuugggg

SEQ ID NO: 729 - RNA, 17 nt, Homo sapiens
ucuuggggguggucuuu

SEQ ID NO: 730 - RNA, 17 nt, Homo sapiens
uggggguggucuuuggg

SEQ ID NO: 731 - RNA, 17 nt, Homo sapiens
cucaucaagcgacggca

SEQ ID NO: 732 - RNA, 17 nt, Homo sapiens
aagcgacggcagcagaa

SEQ ID NO: 733 - RNA, 17 nt, Homo sapiens
cgacggcagcagaagau

SEQ ID NO: 734 - RNA, 17 nt, Homo sapiens
auccggaaguacacgau

SEQ ID NO: 735 - RNA, 17 nt, Homo sapiens
gaaacggagcuggugga

SEQ ID NO: 736 - RNA, 17 nt, Homo sapiens
cggagcugguggagccg

SEQ ID NO: 737 - RNA, 17 nt, Homo sapiens
cugguggagccgcugac

SEQ ID NO: 738 - RNA, 17 nt, Homo sapiens
gacaccuagcggagcga

SEQ ID NO: 739 - RNA, 17 nt, Homo sapiens
cuagcggagcgaugccc

SEQ ID NO: 740 - RNA, 17 nt, Homo sapiens
ccaaccaggcgcagaug

SEQ ID NO: 741 - RNA, 17 nt, Homo sapiens
gagacggagcugaggaa

SEQ ID NO: 742 - RNA, 17 nt, Homo sapiens
ugaggaaggugaaggug

SEQ ID NO: 743 - RNA, 17 nt, Homo sapiens
aggugaaggugcuugga

SEQ ID NO: 744 - RNA, 17 nt, Homo sapiens
uggaucuggcgcuuuug

SEQ ID NO: 745 - RNA, 17 nt, Homo sapiens
cgcuuuuggcacagucu

SEQ ID NO: 746 - RNA, 17 nt, Homo sapiens
uuggcacagucuacaag

SEQ ID NO: 747 - RNA, 17 nt, Homo sapiens
cuacaagggcaucugga

SEQ ID NO: 748 - RNA, 17 nt, Homo sapiens
aaauuccaguggccauc

SEQ ID NO: 749 - RNA, 17 nt, Homo sapiens
uuccaguggccaucaaa

SEQ ID NO: 750 - RNA, 17 nt, Homo sapiens
ccaucaaaguguugagg

SEQ ID NO: 751 - RNA, 17 nt, Homo sapiens
cccccaaagccaacaaa

SEQ ID NO: 752 - RNA, 17 nt, Homo sapiens
uagacgaagcauacgug

SEQ ID NO: 753 - RNA, 17 nt, Homo sapiens
aagcauacgugauggcu

SEQ ID NO: 754 - RNA, 17 nt, Homo sapiens
acgugauggcuggugug

SEQ ID NO: 755 - RNA, 17 nt, Homo sapiens
gauggcuggugugggcu

SEQ ID NO: 756 - RNA, 17 nt, Homo sapiens
uggugugggcuccccau

SEQ ID NO: 757 - RNA, 17 nt, Homo sapiens
ccuucugggcaucugcc

SEQ ID NO: 758 - RNA, 17 nt, Homo sapiens
cauccacggugcagcug

SEQ ID NO: 759 - RNA, 17 nt, Homo sapiens
acggugcagcuggugac

SEQ ID NO: 760 - RNA, 17 nt, Homo sapiens
ugcagcuggugacacag

SEQ ID NO: 761 - RNA, 17 nt, Homo sapiens
gugacacagcuuaugcc

SEQ ID NO: 762 - RNA, 17 nt, Homo sapiens
gcccuauggcugccucu

SEQ ID NO: 763 - RNA, 17 nt, Homo sapiens
acgccugggcucccagg

SEQ ID NO: 764 - RNA, 17 nt, Homo sapiens
cugaacugguguaugca

SEQ ID NO: 765 - RNA, 17 nt, Homo sapiens
ggggaugagcuaccugg

SEQ ID NO: 766 - RNA, 17 nt, Homo sapiens
gaugugcggcucguaca

SEQ ID NO: 767 - RNA, 17 nt, Homo sapiens
ugcggcucguacacagg

SEQ ID NO: 768 - RNA, 17 nt, Homo sapiens
gggacuuggccgcucgg

SEQ ID NO: 769 - RNA, 17 nt, Homo sapiens
cucggaacgugcugguc

SEQ ID NO: 770 - RNA, 17 nt, Homo sapiens
acgugcuggucaagagu

SEQ ID NO: 771 - RNA, 17 nt, Homo sapiens
ggucaagagucccaacc

SEQ ID NO: 772 - RNA, 17 nt, Homo sapiens
gacuucgggcuggcucg

SEQ ID NO: 773 - RNA, 17 nt, Homo sapiens
ucgggcuggcucggcug

SEQ ID NO: 774 - RNA, 17 nt, Homo sapiens
cuggcucggcugcugga

SEQ ID NO: 775 - RNA, 17 nt, Homo sapiens
gagacagaguaccaugc

SEQ ID NO: 776 - RNA, 17 nt, Homo sapiens
agaugggggcaaggugc

SEQ ID NO: 777 - RNA, 17 nt, Homo sapiens
ggggcaaggugcccauc

SEQ ID NO: 778 - RNA, 17 nt, Homo sapiens
cccaucaaguggauggc

SEQ ID NO: 779 - RNA, 17 nt, Homo sapiens
aguggauggcgcuggag

SEQ ID NO: 780 - RNA, 17 nt, Homo sapiens
gcgcuggaguccauucu

SEQ ID NO: 781 - RNA, 17 nt, Homo sapiens
cuccgccggcgguucac

SEQ ID NO: 782 - RNA, 17 nt, Homo sapiens
cgccggcgguucaccca

SEQ ID NO: 783 - RNA, 17 nt, Homo sapiens
ccaccagagugaugugu

SEQ ID NO: 784 - RNA, 17 nt, Homo sapiens
uguguggaguuauggug

SEQ ID NO: 785 - RNA, 17 nt, Homo sapiens
gaguuauggugugacug

SEQ ID NO: 786 - RNA, 17 nt, Homo sapiens
gugugggagcugaugac

SEQ ID NO: 787 - RNA, 17 nt, Homo sapiens
cuuuuggggccaaaccu

SEQ ID NO: 788 - RNA, 17 nt, Homo sapiens
ggaucccagcccgggag

SEQ ID NO: 789 - RNA, 17 nt, Homo sapiens
aagggggagcggcugcc

SEQ ID NO: 790 - RNA, 17 nt, Homo sapiens
ggggagcggcugcccca

SEQ ID NO: 791 - RNA, 17 nt, Homo sapiens
cugccccagccccccau

SEQ ID NO: 792 - RNA, 17 nt, Homo sapiens
ugaucauggucaaaugu

SEQ ID NO: 793 - RNA, 17 nt, Homo sapiens
gaaugucggccaagauu

SEQ ID NO: 794 - RNA, 17 nt, Homo sapiens
uuccgggaguugguguc

SEQ ID NO: 795 - RNA, 17 nt, Homo sapiens
gggaguuggugucugaa

SEQ ID NO: 796 - RNA, 17 nt, Homo sapiens
cccgcauggccagggac

SEQ ID NO: 797 - RNA, 17 nt, Homo sapiens
gacccccagcgcuuugu

SEQ ID NO: 798 - RNA, 17 nt, Homo sapiens
gcuuuguggucauccag

SEQ ID NO: 799 - RNA, 17 nt, Homo sapiens
ggacuugggcccagcca

SEQ ID NO: 800 - RNA, 17 nt, Homo sapiens
ugggcccagccaguccc

SEQ ID NO: 801 - RNA, 17 nt, Homo sapiens
cccagccagucccuugg

SEQ ID NO: 802 - RNA, 17 nt, Homo sapiens
cuuggacagcaccuucu

SEQ ID NO: 803 - RNA, 17 nt, Homo sapiens
gggaccugguggaugcu

SEQ ID NO: 804 - RNA, 17 nt, Homo sapiens
gcugaggaguaucuggu

SEQ ID NO: 805 - RNA, 17 nt, Homo sapiens
aguaucugguaccccag

SEQ ID NO: 806 - RNA, 17 nt, Homo sapiens
guaccccagcagggcuu

SEQ ID NO: 807 - RNA, 17 nt, Homo sapiens
ccagcagggcuucuucu

SEQ ID NO: 808 - RNA, 17 nt, Homo sapiens
ugccccgggcgcugggg

SEQ ID NO: 809 - RNA, 17 nt, Homo sapiens
cgcugggggcauggucc

SEQ ID NO: 810 - RNA, 17 nt, Homo sapiens
ggggcaugguccaccac

SEQ ID NO: 811 - RNA, 17 nt, Homo sapiens
caccacaggcaccgcag

SEQ ID NO: 812 - RNA, 17 nt, Homo sapiens
gcaccgcagcucaucua

SEQ ID NO: 813 - RNA, 17 nt, Homo sapiens
uaccaggaguggcggug

SEQ ID NO: 814 - RNA, 17 nt, Homo sapiens
caggaguggcggugggg

SEQ ID NO: 815 - RNA, 17 nt, Homo sapiens
gaguggcgguggggacc

SEQ ID NO: 816 - RNA, 17 nt, Homo sapiens
acacuagggcuggagcc

SEQ ID NO: 817 - RNA, 17 nt, Homo sapiens
gggcuggagcccucuga

SEQ ID NO: 818 - RNA, 17 nt, Homo sapiens
aagaggaggcccccagg

SEQ ID NO: 819 - RNA, 17 nt, Homo sapiens
gcccccaggucuccacu

SEQ ID NO: 820 - RNA, 17 nt, Homo sapiens
cuccacuggcacccucc

SEQ ID NO: 821 - RNA, 17 nt, Homo sapiens
ccgaaggggcuggcucc

SEQ ID NO: 822 - RNA, 17 nt, Homo sapiens
aggggcuggcuccgaug

SEQ ID NO: 823 - RNA, 17 nt, Homo sapiens
auuugauggugaccugg

SEQ ID NO: 824 - RNA, 17 nt, Homo sapiens
gaaugggggcagccaag

SEQ ID NO: 825 - RNA, 17 nt, Homo sapiens
ugggggcagccaagggg

SEQ ID NO: 826 - RNA, 17 nt, Homo sapiens
gccaaggggcugcaaag

SEQ ID NO: 827 - RNA, 17 nt, Homo sapiens
gcugcaaagccucccca

SEQ ID NO: 828 - RNA, 17 nt, Homo sapiens
ugaccccagcccucuac

SEQ ID NO: 829 - RNA, 17 nt, Homo sapiens
ccucuacagcgguacag

SEQ ID NO: 830 - RNA, 17 nt, Homo sapiens
cuacagcgguacaguga

SEQ ID NO: 831 - RNA, 17 nt, Homo sapiens
gcgguacagugaggacc

SEQ ID NO: 832 - RNA, 17 nt, Homo sapiens
accccacaguaccccug

SEQ ID NO: 833 - RNA, 17 nt, Homo sapiens
gacugauggcuacguug

SEQ ID NO: 834 - RNA, 17 nt, Homo sapiens
auggcuacguugccccc

SEQ ID NO: 835 - RNA, 17 nt, Homo sapiens
gaccugcagcccccagc

SEQ ID NO: 836 - RNA, 17 nt, Homo sapiens
agcccccagccugaaua

SEQ ID NO: 837 - RNA, 17 nt, Homo sapiens
gugaaccagccagaugu

SEQ ID NO: 838 - RNA, 17 nt, Homo sapiens
gauguucggccccagcc

SEQ ID NO: 839 - RNA, 17 nt, Homo sapiens
cggccccagcccccuuc

SEQ ID NO: 840 - RNA, 17 nt, Homo sapiens
ccgagagggcccucugc

SEQ ID NO: 841 - RNA, 17 nt, Homo sapiens
accugcuggugccacuc

SEQ ID NO: 842 - RNA, 17 nt, Homo sapiens
cuggaaaggcccaagac

SEQ ID NO: 843 - RNA, 17 nt, Homo sapiens
agaauggggucgucaaa

SEQ ID NO: 844 - RNA, 17 nt, Homo sapiens
auggggucgucaaagac

SEQ ID NO: 845 - RNA, 17 nt, Homo sapiens
ucaaagacguuuuugcc

SEQ ID NO: 846 - RNA, 17 nt, Homo sapiens
cuuugggggugccgugg

SEQ ID NO: 847 - RNA, 17 nt, Homo sapiens
ggggugccguggagaac

SEQ ID NO: 848 - RNA, 17 nt, Homo sapiens
aaccccgaguacuugac

SEQ ID NO: 849 - RNA, 17 nt, Homo sapiens
agggaggagcugccccu

SEQ ID NO: 850 - RNA, 17 nt, Homo sapiens
gccccucagccccaccc

SEQ ID NO: 851 - RNA, 17 nt, Homo sapiens
ugccuucagcccagccu

SEQ ID NO: 852 - RNA, 17 nt, Homo sapiens
ucagcccagccuucgac

SEQ ID NO: 853 - RNA, 17 nt, Homo sapiens
ccaccagagcggggggc

SEQ ID NO: 854 - RNA, 17 nt, Homo sapiens
agcggggggcuccaccc

SEQ ID NO: 855 - RNA, 17 nt, Homo sapiens
uccacccagcaccuuca

SEQ ID NO: 856 - RNA, 17 nt, Homo sapiens
caccuacggcagagaac

SEQ ID NO: 857 - RNA, 17 nt, Homo sapiens
aacccagaguaccuggg

SEQ ID NO: 858 - RNA, 17 nt, Homo sapiens
guaccugggucuggacg

SEQ ID NO: 859 - RNA, 17 nt, Homo sapiens
gucuggacgugccagug

SEQ ID NO: 860 - RNA, 17 nt, Homo sapiens
acgugccagugugaacc

SEQ ID NO: 861 - RNA, 17 nt, Homo sapiens
accagaaggccaagucc

SEQ ID NO: 862 - RNA, 17 nt, Homo sapiens
aaggccaaguccgcaga

SEQ ID NO: 863 - RNA, 17 nt, Homo sapiens
ccgcagaagcccugaug

SEQ ID NO: 864 - RNA, 17 nt, Homo sapiens
cucagggagcagggaag

SEQ ID NO: 865 - RNA, 17 nt, Homo sapiens
cagggaaggccugacuu

SEQ ID NO: 866 - RNA, 17 nt, Homo sapiens
uucugcuggcaucaaga

SEQ ID NO: 867 - RNA, 17 nt, Homo sapiens
aucaagaggugggaggg

SEQ ID NO: 868 - RNA, 17 nt, Homo sapiens
gugggagggcccuccga

SEQ ID NO: 869 - RNA, 17 nt, Homo sapiens
cugcuugaguucccaga

SEQ ID NO: 870 - RNA, 17 nt, Homo sapiens
cccagauggcuggaagg

SEQ ID NO: 871 - RNA, 17 nt, Homo sapiens
uggaagggguccagccu

SEQ ID NO: 872 - RNA, 17 nt, Homo sapiens
gggguccagccucguug

SEQ ID NO: 873 - RNA, 17 nt, Homo sapiens
ccagccucguuggaaga

SEQ ID NO: 874 - RNA, 17 nt, Homo sapiens
gaggaacagcacugggg

SEQ ID NO: 875 - RNA, 17 nt, Homo sapiens
acuggggagucuuugug

SEQ ID NO: 876 - RNA, 17 nt, Homo sapiens
auucugaggcccugccc

SEQ ID NO: 877 - RNA, 17 nt, Homo sapiens
acucuaggguccagugg

SEQ ID NO: 878 - RNA, 17 nt, Homo sapiens
aggguccaguggaugcc

SEQ ID NO: 879 - RNA, 17 nt, Homo sapiens
augccacagcccagcuu

SEQ ID NO: 880 - RNA, 17 nt, Homo sapiens
acagcccagcuuggccc

SEQ ID NO: 881 - RNA, 17 nt, Homo sapiens
ccagcuuggcccuuucc

SEQ ID NO: 882 - RNA, 17 nt, Homo sapiens
gauccuggguacugaaa

SEQ ID NO: 883 - RNA, 17 nt, Homo sapiens
uacugaaagccuuaggg

SEQ ID NO: 884 - RNA, 17 nt, Homo sapiens
uuagggaagcuggccug

SEQ ID NO: 885 - RNA, 17 nt, Homo sapiens
ggaagcuggccugagag

SEQ ID NO: 886 - RNA, 17 nt, Homo sapiens
gaggggaagcggcccua

SEQ ID NO: 887 - RNA, 17 nt, Homo sapiens
gggaagcggcccuaagg

SEQ ID NO: 888 - RNA, 17 nt, Homo sapiens
cuaagggagugucuaag

SEQ ID NO: 889 - RNA, 17 nt, Homo sapiens
gaacaaaagcgacccau

SEQ ID NO: 890 - RNA, 17 nt, Homo sapiens
gaaaccuaguacugccc

SEQ ID NO: 891 - RNA, 17 nt, Homo sapiens
aaggaacagcaauggug

SEQ ID NO: 892 - RNA, 17 nt, Homo sapiens
cagcaauggugucagua

SEQ ID NO: 893 - RNA, 17 nt, Homo sapiens
uggugucaguauccagg

SEQ ID NO: 894 - RNA, 17 nt, Homo sapiens
guauccaggcuuuguac

SEQ ID NO: 895 - RNA, 17 nt, Homo sapiens
uguacagagugcuuuuc

SEQ ID NO: 896 - RNA, 17 nt, Homo sapiens
ucuguuuaguuuuuacu

SEQ ID NO: 897 - RNA, 38 nt, Artificial Sequence
  Description of Artificial Sequence:  Enzymatic Nucleic Acid
ggggcgcggccgaaaggcgagucaaggucuggcugccc

SEQ ID NO: 898 - RNA, 38 nt, Artificial Sequence
  Description of Artificial Sequence:  Enzymatic Nucleic Acid
aaggggcggccgaaaggcgagucaaggucugcggcugc

SEQ ID NO: 899 - RNA, 38 nt, Artificial Sequence
  Description of Artificial Sequence:  Enzymatic Nucleic Acid
ggaagggggccgaaaggcgagucaaggucugcgcggcu

SEQ ID NO: 900 - RNA, 38 nt, Artificial Sequence
  Description of Artificial Sequence:  Enzymatic Nucleic Acid
gcgcggcggccgaaaggcgagucaaggucuaguaaagg

SEQ ID NO: 901 - RNA, 38 nt, Artificial Sequence
  Description of Artificial Sequence:  Enzymatic Nucleic Acid
gcgcgcgggccgaaaggcgagucaaggucugcaguaaa

SEQ ID NO: 902 - RNA, 38 nt, Artificial Sequence
  Description of Artificial Sequence:  Enzymatic Nucleic Acid
cgggcgcggccgaaaggcgagucaaggucuggcgcagu

SEQ ID NO: 903 - RNA, 38 nt, Artificial Sequence
  Description of Artificial Sequence:  Enzymatic Nucleic Acid
gccgggcggccgaaaggcgagucaaggucugcggcgca

SEQ ID NO: 904 - RNA, 38 nt, Artificial Sequence
  Description of Artificial Sequence:  Enzymatic Nucleic Acid
gggccggggccgaaaggcgagucaaggucugcgcggcg

SEQ ID NO: 905 - RNA, 38 nt, Artificial Sequence
  Description of Artificial Sequence:  Enzymatic Nucleic Acid
gggugcuggccgaaaggcgagucaaggucugaggggug

SEQ ID NO: 906 - RNA, 38 nt, Artificial Sequence
  Description of Artificial Sequence:  Enzymatic Nucleic Acid
gcggggcggccgaaaggcgagucaaggucuggggugcu

SEQ ID NO: 907 - RNA, 38 nt, Artificial Sequence
  Description of Artificial Sequence:  Enzymatic Nucleic Acid
gcgcgggggccgaaaggcgagucaaggucugcggggug

SEQ ID NO: 908 - RNA, 38 nt, Artificial Sequence
  Description of Artificial Sequence:  Enzymatic Nucleic Acid
ggagggcggccgaaaggcgagucaaggucuggggcgcg

SEQ ID NO: 909 - RNA, 38 nt, Artificial Sequence
  Description of Artificial Sequence:  Enzymatic Nucleic Acid
ugggaggggccgaaaggcgagucaaggucugcggggcg

SEQ ID NO: 910 - RNA, 38 nt, Artificial Sequence
  Description of Artificial Sequence:  Enzymatic Nucleic Acid
gcucacuggccgaaaggcgagucaaggucuggcuccgg

SEQ ID NO: 911 - RNA, 38 nt, Artificial Sequence
  Description of Artificial Sequence:  Enzymatic Nucleic Acid
cccagcgggccgaaaggcgagucaaggucuacaaggcc

SEQ ID NO: 912 - RNA, 38 nt, Artificial Sequence
  Description of Artificial Sequence:  Enzymatic Nucleic Acid
gcccccaggccgaaaggcgagucaaggucuggcacaag

SEQ ID NO: 913 - RNA, 38 nt, Artificial Sequence
  Description of Artificial Sequence:  Enzymatic Nucleic Acid
caagaggggccgaaaggcgagucaaggucugaggagga

SEQ ID NO: 914 - RNA, 38 nt, Artificial Sequence
  Description of Artificial Sequence:  Enzymatic Nucleic Acid
ccgggggggccgaaaggcgagucaaggucuaagagggc

SEQ ID NO: 915 - RNA, 38 nt, Artificial Sequence
  Description of Artificial Sequence:  Enzymatic Nucleic Acid
ggugcucggccgaaaggcgagucaaggucuggcuccgg

SEQ ID NO: 916 - RNA, 38 nt, Artificial Sequence
  Description of Artificial Sequence:  Enzymatic Nucleic Acid
ugccgguggccgaaaggcgagucaaggucuacacuugg

SEQ ID NO: 917 - RNA, 38 nt, Artificial Sequence
  Description of Artificial Sequence:  Enzymatic Nucleic Acid
gggagccggccgaaaggcgagucaaggucuagcuucau

SEQ ID NO: 918 - RNA, 38 nt, Artificial Sequence
  Description of Artificial Sequence:  Enzymatic Nucleic Acid
gggacugggccgaaaggcgagucaaggucuagggagcc

SEQ ID NO: 919 - RNA, 38 nt, Artificial Sequence
  Description of Artificial Sequence:  Enzymatic Nucleic Acid
uggcggaggccgaaaggcgagucaaggucuauguccag

SEQ ID NO: 920 - RNA, 38 nt, Artificial Sequence
  Description of Artificial Sequence:  Enzymatic Nucleic Acid
agaggugggccgaaaggcgagucaaggucuggagcaug

SEQ ID NO: 921 - RNA, 38 nt, Artificial Sequence
  Description of Artificial Sequence:  Enzymatic Nucleic Acid
ccaccugggccgaaaggcgagucaaggucuagcccugg

SEQ ID NO: 922 - RNA, 38 nt, Artificial Sequence
  Description of Artificial Sequence:  Enzymatic Nucleic Acid
uuucccuggccgaaaggcgagucaaggucuaccaccug

SEQ ID NO: 923 - RNA, 38 nt, Artificial Sequence
  Description of Artificial Sequence:  Enzymatic Nucleic Acid
uugguggggccgaaaggcgagucaaggucuagguaggu

SEQ ID NO: 924 - RNA, 38 nt, Artificial Sequence
  Description of Artificial Sequence:  Enzymatic Nucleic Acid
caggcugggccgaaaggcgagucaaggucuauuggugg

SEQ ID NO: 925 - RNA, 38 nt, Artificial Sequence
  Description of Artificial Sequence:  Enzymatic Nucleic Acid
auauccuggccgaaaggcgagucaaggucuaggaagga

SEQ ID NO: 926 - RNA, 38 nt, Artificial Sequence
  Description of Artificial Sequence:  Enzymatic Nucleic Acid
uagcccuggccgaaaggcgagucaaggucuaccuccug

SEQ ID NO: 927 - RNA, 38 nt, Artificial Sequence
  Description of Artificial Sequence:  Enzymatic Nucleic Acid
gcgaugaggccgaaaggcgagucaaggucuacguagcc

SEQ ID NO: 928 - RNA, 38 nt, Artificial Sequence
  Description of Artificial Sequence:  Enzymatic Nucleic Acid
guugugaggccgaaaggcgagucaaggucugaugagca

SEQ ID NO: 929 - RNA, 38 nt, Artificial Sequence
  Description of Artificial Sequence:  Enzymatic Nucleic Acid
agccucuggccgaaaggcgagucaaggucuagugggac

SEQ ID NO: 930 - RNA, 38 nt, Artificial Sequence
  Description of Artificial Sequence:  Enzymatic Nucleic Acid
acaauccggccgaaaggcgagucaaggucuagccucug

SEQ ID NO: 931 - RNA, 38 nt, Artificial Sequence
  Description of Artificial Sequence:  Enzymatic Nucleic Acid
gugccucggccgaaaggcgagucaaggucuacaauccg

SEQ ID NO: 932 - RNA, 38 nt, Artificial Sequence
  Description of Artificial Sequence:  Enzymatic Nucleic Acid
ggccaggggccgaaaggcgagucaaggucuauaguugu

SEQ ID NO: 933 - RNA, 38 nt, Artificial Sequence
  Description of Artificial Sequence:  Enzymatic Nucleic Acid
uugucuaggccgaaaggcgagucaaggucuacggccag

SEQ ID NO: 934 - RNA, 38 nt, Artificial Sequence
  Description of Artificial Sequence:  Enzymatic Nucleic Acid
uuguucaggccgaaaggcgagucaaggucugggucucc

SEQ ID NO: 935 - RNA, 38 nt, Artificial Sequence
  Description of Artificial Sequence:  Enzymatic Nucleic Acid
agcucccggccgaaaggcgagucaaggucuaggccucc

SEQ ID NO: 936 - RNA, 38 nt, Artificial Sequence
  Description of Artificial Sequence:  Enzymatic Nucleic Acid
cgaagcuggccgaaaggcgagucaaggucuagcucccg

SEQ ID NO: 937 - RNA, 38 nt, Artificial Sequence
  Description of Artificial Sequence:  Enzymatic Nucleic Acid
ccugguaggccgaaaggcgagucaaggucuagagcugg

SEQ ID NO: 938 - RNA, 38 nt, Artificial Sequence
  Description of Artificial Sequence:  Enzymatic Nucleic Acid
cccgagaggccgaaaggcgagucaaggucugguuggug

SEQ ID NO: 939 - RNA, 38 nt, Artificial Sequence
  Description of Artificial Sequence:  Enzymatic Nucleic Acid
aggggugggccgaaaggcgagucaaggucuaggcccga

SEQ ID NO: 940 - RNA, 38 nt, Artificial Sequence
  Description of Artificial Sequence:  Enzymatic Nucleic Acid
cccagcaggccgaaaggcgagucaaggucugggagccc

SEQ ID NO: 941 - RNA, 38 nt, Artificial Sequence
  Description of Artificial Sequence:  Enzymatic Nucleic Acid
cuccccaggccgaaaggcgagucaaggucuagcgggag

SEQ ID NO: 942 - RNA, 38 nt, Artificial Sequence
  Description of Artificial Sequence:  Enzymatic Nucleic Acid
acagugcggccgaaaggcgagucaaggucugucaggcu

SEQ ID NO: 943 - RNA, 38 nt, Artificial Sequence
  Description of Artificial Sequence:  Enzymatic Nucleic Acid
agacaguggccgaaaggcgagucaaggucugcgucagg

SEQ ID NO: 944 - RNA, 38 nt, Artificial Sequence
  Description of Artificial Sequence:  Enzymatic Nucleic Acid
gccaccgggccgaaaggcgagucaaggucuacagacag

SEQ ID NO: 945 - RNA, 38 nt, Artificial Sequence
  Description of Artificial Sequence:  Enzymatic Nucleic Acid
gcagcggggccgaaaggcgagucaaggucuacagccac

SEQ ID NO: 946 - RNA, 38 nt, Artificial Sequence
  Description of Artificial Sequence:  Enzymatic Nucleic Acid
ccuugcaggccgaaaggcgagucaaggucugggcacag

SEQ ID NO: 947 - RNA, 38 nt, Artificial Sequence
  Description of Artificial Sequence:  Enzymatic Nucleic Acid
gccccuuggccgaaaggcgagucaaggucuagcgggca

SEQ ID NO: 948 - RNA, 38 nt, Artificial Sequence
  Description of Artificial Sequence:  Enzymatic Nucleic Acid
ucaguggggccgaaaggcgagucaaggucuaguggccc

SEQ ID NO: 949 - RNA, 38 nt, Artificial Sequence
  Description of Artificial Sequence:  Enzymatic Nucleic Acid
cauggcaggccgaaaggcgagucaaggucuagucagug

SEQ ID NO: 950 - RNA, 38 nt, Artificial Sequence
  Description of Artificial Sequence:  Enzymatic Nucleic Acid
gcucaugggccgaaaggcgagucaaggucuagcaguca

SEQ ID NO: 951 - RNA, 38 nt, Artificial Sequence
  Description of Artificial Sequence:  Enzymatic Nucleic Acid
gccggcaggccgaaaggcgagucaaggucuacacugcu

SEQ ID NO: 952 - RNA, 38 nt, Artificial Sequence
  Description of Artificial Sequence:  Enzymatic Nucleic Acid
gcagccgggccgaaaggcgagucaaggucuagcacacu

SEQ ID NO: 953 - RNA, 38 nt, Artificial Sequence
  Description of Artificial Sequence:  Enzymatic Nucleic Acid
ggcccguggccgaaaggcgagucaaggucuagccggca

SEQ ID NO: 954 - RNA, 38 nt, Artificial Sequence
  Description of Artificial Sequence:  Enzymatic Nucleic Acid
aggccagggccgaaaggcgagucaaggucuagucagag

SEQ ID NO: 955 - RNA, 38 nt, Artificial Sequence
  Description of Artificial Sequence:  Enzymatic Nucleic Acid
aguggagggccgaaaggcgagucaaggucuaggccagg

SEQ ID NO: 956 - RNA, 38 nt, Artificial Sequence
  Description of Artificial Sequence:  Enzymatic Nucleic Acid
gggcaguggccgaaaggcgagucaaggucuagcucaca

SEQ ID NO: 957 - RNA, 38 nt, Artificial Sequence
  Description of Artificial Sequence:  Enzymatic Nucleic Acid
gggcuggggccgaaaggcgagucaaggucuagugcagc

SEQ ID NO: 958 - RNA, 38 nt, Artificial Sequence
  Description of Artificial Sequence:  Enzymatic Nucleic Acid
ggauuggggccgaaaggcgagucaaggucuauggacuc

SEQ ID NO: 959 - RNA, 38 nt, Artificial Sequence
  Description of Artificial Sequence:  Enzymatic Nucleic Acid
acagcugggccgaaaggcgagucaaggucugccgaaug

SEQ ID NO: 960 - RNA, 38 nt, Artificial Sequence
  Description of Artificial Sequence:  Enzymatic Nucleic Acid
gggacagggccgaaaggcgagucaaggucuagucacac

SEQ ID NO: 961 - RNA, 38 nt, Artificial Sequence
  Description of Artificial Sequence:  Enzymatic Nucleic Acid
cgaggguggccgaaaggcgagucaaggucuaggauccc

SEQ ID NO: 962 - RNA, 38 nt, Artificial Sequence
  Description of Artificial Sequence:  Enzymatic Nucleic Acid
gcaggggggccgaaaggcgagucaaggucuagacgagg

SEQ ID NO: 963 - RNA, 38 nt, Artificial Sequence
  Description of Artificial Sequence:  Enzymatic Nucleic Acid
ugguuguggccgaaaggcgagucaaggucuagggggca

SEQ ID NO: 964 - RNA, 38 nt, Artificial Sequence
  Description of Artificial Sequence:  Enzymatic Nucleic Acid
gcuugcuggccgaaaggcgagucaaggucuacuucuca

SEQ ID NO: 965 - RNA, 38 nt, Artificial Sequence
  Description of Artificial Sequence:  Enzymatic Nucleic Acid
cacucggggccgaaaggcgagucaaggucuacagggcu

SEQ ID NO: 966 - RNA, 38 nt, Artificial Sequence
  Description of Artificial Sequence:  Enzymatic Nucleic Acid
gaccauaggccgaaaggcgagucaaggucuacacucgg

SEQ ID NO: 967 - RNA, 38 nt, Artificial Sequence
  Description of Artificial Sequence:  Enzymatic Nucleic Acid
accucucggccgaaaggcgagucaaggucuaagugcuc

SEQ ID NO: 968 - RNA, 38 nt, Artificial Sequence
  Description of Artificial Sequence:  Enzymatic Nucleic Acid
gauauugggccgaaaggcgagucaaggucuacugguaa

SEQ ID NO: 969 - RNA, 38 nt, Artificial Sequence
  Description of Artificial Sequence:  Enzymatic Nucleic Acid
gcagccaggccgaaaggcgagucaaggucuaaacuccu

SEQ ID NO: 970 - RNA, 38 nt, Artificial Sequence
  Description of Artificial Sequence:  Enzymatic Nucleic Acid
ucuucuuggccgaaaggcgagucaaggucuagccagca

SEQ ID NO: 971 - RNA, 38 nt, Artificial Sequence
  Description of Artificial Sequence:  Enzymatic Nucleic Acid
cucuccgggccgaaaggcgagucaaggucuagaaaugc

SEQ ID NO: 972 - RNA, 38 nt, Artificial Sequence
  Description of Artificial Sequence:  Enzymatic Nucleic Acid
gagcgggggccgaaaggcgagucaaggucuaguguugg

SEQ ID NO: 973 - RNA, 38 nt, Artificial Sequence
  Description of Artificial Sequence:  Enzymatic Nucleic Acid
ggcuggaggccgaaaggcgagucaaggucuggggcagu

SEQ ID NO: 974 - RNA, 38 nt, Artificial Sequence
  Description of Artificial Sequence:  Enzymatic Nucleic Acid
aggucagggccgaaaggcgagucaaggucuaggcuguc

SEQ ID NO: 975 - RNA, 38 nt, Artificial Sequence
  Description of Artificial Sequence:  Enzymatic Nucleic Acid
auuacuuggccgaaaggcgagucaaggucuagguucug

SEQ ID NO: 976 - RNA, 38 nt, Artificial Sequence
  Description of Artificial Sequence:  Enzymatic Nucleic Acid
ccauuguggccgaaaggcgagucaaggucuagaauucg

SEQ ID NO: 977 - RNA, 38 nt, Artificial Sequence
  Description of Artificial Sequence:  Enzymatic Nucleic Acid
cgaguagggccgaaaggcgagucaaggucugccauugu

SEQ ID NO: 978 - RNA, 38 nt, Artificial Sequence
  Description of Artificial Sequence:  Enzymatic Nucleic Acid
agggucaggccgaaaggcgagucaaggucugaguaggc

SEQ ID NO: 979 - RNA, 38 nt, Artificial Sequence
  Description of Artificial Sequence:  Enzymatic Nucleic Acid
agcccuuggccgaaaggcgagucaaggucuagggucag

SEQ ID NO: 980 - RNA, 38 nt, Artificial Sequence
  Description of Artificial Sequence:  Enzymatic Nucleic Acid
agugagcggccgaaaggcgagucaaggucuagccccag

SEQ ID NO: 981 - RNA, 38 nt, Artificial Sequence
  Description of Artificial Sequence:  Enzymatic Nucleic Acid
ucagugaggccgaaaggcgagucaaggucugcagcccc

SEQ ID NO: 982 - RNA, 38 nt, Artificial Sequence
  Description of Artificial Sequence:  Enzymatic Nucleic Acid
gcacgaaggccgaaaggcgagucaaggucuagaggugg

SEQ ID NO: 983 - RNA, 38 nt, Artificial Sequence
  Description of Artificial Sequence:  Enzymatic Nucleic Acid
accguguggccgaaaggcgagucaaggucuacgaagca

SEQ ID NO: 984 - RNA, 38 nt, Artificial Sequence
  Description of Artificial Sequence:  Enzymatic Nucleic Acid
ucccaggggccgaaaggcgagucaaggucuaccgugug

SEQ ID NO: 985 - RNA, 38 nt, Artificial Sequence
  Description of Artificial Sequence:  Enzymatic Nucleic Acid
gcuugguggccgaaaggcgagucaaggucuggguuccg

SEQ ID NO: 986 - RNA, 38 nt, Artificial Sequence
  Description of Artificial Sequence:  Enzymatic Nucleic Acid
guguggaggccgaaaggcgagucaaggucuagagcuug

SEQ ID NO: 987 - RNA, 38 nt, Artificial Sequence
  Description of Artificial Sequence:  Enzymatic Nucleic Acid
ccgguugggccgaaaggcgagucaaggucuagugugga

SEQ ID NO: 988 - RNA, 38 nt, Artificial Sequence
  Description of Artificial Sequence:  Enzymatic Nucleic Acid
gcuggugggccgaaaggcgagucaaggucuaggccagg

SEQ ID NO: 989 - RNA, 38 nt, Artificial Sequence
  Description of Artificial Sequence:  Enzymatic Nucleic Acid
cucgggcggccgaaaggcgagucaaggucuacagcugg

SEQ ID NO: 990 - RNA, 38 nt, Artificial Sequence
  Description of Artificial Sequence:  Enzymatic Nucleic Acid
cccucggggccgaaaggcgagucaaggucugcacagcu

SEQ ID NO: 991 - RNA, 38 nt, Artificial Sequence
  Description of Artificial Sequence:  Enzymatic Nucleic Acid
gaccccaggccgaaaggcgagucaaggucuagugcccu

SEQ ID NO: 992 - RNA, 38 nt, Artificial Sequence
  Description of Artificial Sequence:  Enzymatic Nucleic Acid
acuggcuggccgaaaggcgagucaaggucuaguugaca

SEQ ID NO: 993 - RNA, 38 nt, Artificial Sequence
  Description of Artificial Sequence:  Enzymatic Nucleic Acid
ccuccacggccgaaaggcgagucaaggucuacuccugg

SEQ ID NO: 994 - RNA, 38 nt, Artificial Sequence
  Description of Artificial Sequence:  Enzymatic Nucleic Acid
guacucgggccgaaaggcgagucaaggucuauuccucc

SEQ ID NO: 995 - RNA, 38 nt, Artificial Sequence
  Description of Artificial Sequence:  Enzymatic Nucleic Acid
agccccuggccgaaaggcgagucaaggucuaguacucg

SEQ ID NO: 996 - RNA, 38 nt, Artificial Sequence
  Description of Artificial Sequence:  Enzymatic Nucleic Acid
gugccugggccgaaaggcgagucaaggucuauucacau

SEQ ID NO: 997 - RNA, 38 nt, Artificial Sequence
  Description of Artificial Sequence:  Enzymatic Nucleic Acid
uggcacgggccgaaaggcgagucaaggucuaaacagug

SEQ ID NO: 998 - RNA, 38 nt, Artificial Sequence
  Description of Artificial Sequence:  Enzymatic Nucleic Acid
cagggugggccgaaaggcgagucaaggucuacggcaaa

SEQ ID NO: 999 - RNA, 38 nt, Artificial Sequence
  Description of Artificial Sequence:  Enzymatic Nucleic Acid
auaguggggccgaaaggcgagucaaggucuacaggcca

SEQ ID NO: 1000 - RNA, 38 nt, Artificial Sequence
  Description of Artificial Sequence:  Enzymatic Nucleic Acid
gggccacggccgaaaggcgagucaaggucuagaaggga

SEQ ID NO: 1001 - RNA, 38 nt, Artificial Sequence
  Description of Artificial Sequence:  Enzymatic Nucleic Acid
uggggcaggccgaaaggcgagucaaggucugggccacg

SEQ ID NO: 1002 - RNA, 38 nt, Artificial Sequence
  Description of Artificial Sequence:  Enzymatic Nucleic Acid
cgcugggggccgaaaggcgagucaaggucuagcgggcc

SEQ ID NO: 1003 - RNA, 38 nt, Artificial Sequence
  Description of Artificial Sequence:  Enzymatic Nucleic Acid
cagauggggccgaaaggcgagucaaggucuauguagga

SEQ ID NO: 1004 - RNA, 38 nt, Artificial Sequence
  Description of Artificial Sequence:  Enzymatic Nucleic Acid
cuggcauggccgaaaggcgagucaaggucugcccuccu

SEQ ID NO: 1005 - RNA, 38 nt, Artificial Sequence
  Description of Artificial Sequence:  Enzymatic Nucleic Acid
aaggcugggccgaaaggcgagucaaggucuaugcgccc

SEQ ID NO: 1006 - RNA, 38 nt, Artificial Sequence
  Description of Artificial Sequence:  Enzymatic Nucleic Acid
ugaugggggccgaaaggcgagucaaggucuaaggcugg

SEQ ID NO: 1007 - RNA, 38 nt, Artificial Sequence
  Description of Artificial Sequence:  Enzymatic Nucleic Acid
aguggguggccgaaaggcgagucaaggucuaguugaug

SEQ ID NO: 1008 - RNA, 38 nt, Artificial Sequence
  Description of Artificial Sequence:  Enzymatic Nucleic Acid
cggcgggggccgaaaggcgagucaaggucuagcccuug

SEQ ID NO: 1009 - RNA, 38 nt, Artificial Sequence
  Description of Artificial Sequence:  Enzymatic Nucleic Acid
cugcucgggccgaaaggcgagucaaggucuggggcagc

SEQ ID NO: 1010 - RNA, 38 nt, Artificial Sequence
  Description of Artificial Sequence:  Enzymatic Nucleic Acid
aaccaccggccgaaaggcgagucaaggucuagagauga

SEQ ID NO: 1011 - RNA, 38 nt, Artificial Sequence
  Description of Artificial Sequence:  Enzymatic Nucleic Acid
acgaccaggccgaaaggcgagucaaggucuagaaugcc

SEQ ID NO: 1012 - RNA, 38 nt, Artificial Sequence
  Description of Artificial Sequence:  Enzymatic Nucleic Acid
agucuccggccgaaaggcgagucaaggucuaucgugua

SEQ ID NO: 1013 - RNA, 38 nt, Artificial Sequence
  Description of Artificial Sequence:  Enzymatic Nucleic Acid
uccugcaggccgaaaggcgagucaaggucuagucuccg

SEQ ID NO: 1014 - RNA, 38 nt, Artificial Sequence
  Description of Artificial Sequence:  Enzymatic Nucleic Acid
guuuccuggccgaaaggcgagucaaggucuagcagucu

SEQ ID NO: 1015 - RNA, 38 nt, Artificial Sequence
  Description of Artificial Sequence:  Enzymatic Nucleic Acid
ggugucaggccgaaaggcgagucaaggucuggcuccac

SEQ ID NO: 1016 - RNA, 38 nt, Artificial Sequence
  Description of Artificial Sequence:  Enzymatic Nucleic Acid
ugguuggggccgaaaggcgagucaaggucuaucgcucc

SEQ ID NO: 1017 - RNA, 38 nt, Artificial Sequence
  Description of Artificial Sequence:  Enzymatic Nucleic Acid
cgcaucuggccgaaaggcgagucaaggucugccugguu

SEQ ID NO: 1018 - RNA, 38 nt, Artificial Sequence
  Description of Artificial Sequence:  Enzymatic Nucleic Acid
aggauccggccgaaaggcgagucaaggucuaucugcgc

SEQ ID NO: 1019 - RNA, 38 nt, Artificial Sequence
  Description of Artificial Sequence:  Enzymatic Nucleic Acid
gauccaaggccgaaaggcgagucaaggucuaccuucac

SEQ ID NO: 1020 - RNA, 38 nt, Artificial Sequence
  Description of Artificial Sequence:  Enzymatic Nucleic Acid
gccaaaaggccgaaaggcgagucaaggucugccagauc

SEQ ID NO: 1021 - RNA, 38 nt, Artificial Sequence
  Description of Artificial Sequence:  Enzymatic Nucleic Acid
ccagaagggccgaaaggcgagucaaggucugggagaca

SEQ ID NO: 1022 - RNA, 38 nt, Artificial Sequence
  Description of Artificial Sequence:  Enzymatic Nucleic Acid
augucagggccgaaaggcgagucaaggucuagaugccc

SEQ ID NO: 1023 - RNA, 38 nt, Artificial Sequence
  Description of Artificial Sequence:  Enzymatic Nucleic Acid
accagcuggccgaaaggcgagucaaggucuaccgugga

SEQ ID NO: 1024 - RNA, 38 nt, Artificial Sequence
  Description of Artificial Sequence:  Enzymatic Nucleic Acid
ccauaggggccgaaaggcgagucaaggucuauaagcug

SEQ ID NO: 1025 - RNA, 38 nt, Artificial Sequence
  Description of Artificial Sequence:  Enzymatic Nucleic Acid
cuaagagggccgaaaggcgagucaaggucuagccauag

SEQ ID NO: 1026 - RNA, 38 nt, Artificial Sequence
  Description of Artificial Sequence:  Enzymatic Nucleic Acid
ggcguccggccgaaaggcgagucaaggucugguuuucc

SEQ ID NO: 1027 - RNA, 38 nt, Artificial Sequence
  Description of Artificial Sequence:  Enzymatic Nucleic Acid
agcccagggccgaaaggcgagucaaggucuguccgcgg

SEQ ID NO: 1028 - RNA, 38 nt, Artificial Sequence
  Description of Artificial Sequence:  Enzymatic Nucleic Acid
caguucaggccgaaaggcgagucaaggucuagguccug

SEQ ID NO: 1029 - RNA, 38 nt, Artificial Sequence
  Description of Artificial Sequence:  Enzymatic Nucleic Acid
gcaaucuggccgaaaggcgagucaaggucuauacacca

SEQ ID NO: 1030 - RNA, 38 nt, Artificial Sequence
  Description of Artificial Sequence:  Enzymatic Nucleic Acid
ccccuugggccgaaaggcgagucaaggucuaaucugca

SEQ ID NO: 1031 - RNA, 38 nt, Artificial Sequence
  Description of Artificial Sequence:  Enzymatic Nucleic Acid
acgagccggccgaaaggcgagucaaggucuacauccuc

SEQ ID NO: 1032 - RNA, 38 nt, Artificial Sequence
  Description of Artificial Sequence:  Enzymatic Nucleic Acid
guuccgaggccgaaaggcgagucaaggucuggccaagu

SEQ ID NO: 1033 - RNA, 38 nt, Artificial Sequence
  Description of Artificial Sequence:  Enzymatic Nucleic Acid
uugaccaggccgaaaggcgagucaaggucuacguuccg

SEQ ID NO: 1034 - RNA, 38 nt, Artificial Sequence
  Description of Artificial Sequence:  Enzymatic Nucleic Acid
auguccaggccgaaaggcgagucaaggucuagccgagc

SEQ ID NO: 1035 - RNA, 38 nt, Artificial Sequence
  Description of Artificial Sequence:  Enzymatic Nucleic Acid
cccaucuggccgaaaggcgagucaaggucuaugguacu

SEQ ID NO: 1036 - RNA, 38 nt, Artificial Sequence
  Description of Artificial Sequence:  Enzymatic Nucleic Acid
uugauggggccgaaaggcgagucaaggucuaccuugcc

SEQ ID NO: 1037 - RNA, 38 nt, Artificial Sequence
  Description of Artificial Sequence:  Enzymatic Nucleic Acid
gacuccaggccgaaaggcgagucaaggucugccaucca

SEQ ID NO: 1038 - RNA, 38 nt, Artificial Sequence
  Description of Artificial Sequence:  Enzymatic Nucleic Acid
accgccgggccgaaaggcgagucaaggucuggagaaug

SEQ ID NO: 1039 - RNA, 38 nt, Artificial Sequence
  Description of Artificial Sequence:  Enzymatic Nucleic Acid
uuuuccaggccgaaaggcgagucaaggucuaggucagg

SEQ ID NO: 1040 - RNA, 38 nt, Artificial Sequence
  Description of Artificial Sequence:  Enzymatic Nucleic Acid
ggcugggggccgaaaggcgagucaaggucuagccgcuc

SEQ ID NO: 1041 - RNA, 38 nt, Artificial Sequence
  Description of Artificial Sequence:  Enzymatic Nucleic Acid
caaugguggccgaaaggcgagucaaggucuagaugggg

SEQ ID NO: 1042 - RNA, 38 nt, Artificial Sequence
  Description of Artificial Sequence:  Enzymatic Nucleic Acid
uggccauggccgaaaggcgagucaaggucugggagaau

SEQ ID NO: 1043 - RNA, 38 nt, Artificial Sequence
  Description of Artificial Sequence:  Enzymatic Nucleic Acid
ccacaaaggccgaaaggcgagucaaggucugcuggggg

SEQ ID NO: 1044 - RNA, 38 nt, Artificial Sequence
  Description of Artificial Sequence:  Enzymatic Nucleic Acid
gcagugaggccgaaaggcgagucaaggucugguagaag

SEQ ID NO: 1045 - RNA, 38 nt, Artificial Sequence
  Description of Artificial Sequence:  Enzymatic Nucleic Acid
uccuccaggccgaaaggcgagucaaggucuagugagcg

SEQ ID NO: 1046 - RNA, 38 nt, Artificial Sequence
  Description of Artificial Sequence:  Enzymatic Nucleic Acid
cuccucaggccgaaaggcgagucaaggucuauccacca

SEQ ID NO: 1047 - RNA, 38 nt, Artificial Sequence
  Description of Artificial Sequence:  Enzymatic Nucleic Acid
gcccgggggccgaaaggcgagucaaggucuagggucug

SEQ ID NO: 1048 - RNA, 38 nt, Artificial Sequence
  Description of Artificial Sequence:  Enzymatic Nucleic Acid
gcccccaggccgaaaggcgagucaaggucugcccgggg

SEQ ID NO: 1049 - RNA, 38 nt, Artificial Sequence
  Description of Artificial Sequence:  Enzymatic Nucleic Acid
augagcuggccgaaaggcgagucaaggucuggugccug

SEQ ID NO: 1050 - RNA, 38 nt, Artificial Sequence
  Description of Artificial Sequence:  Enzymatic Nucleic Acid
aggcuuuggccgaaaggcgagucaaggucuagccccuu

SEQ ID NO: 1051 - RNA, 38 nt, Artificial Sequence
  Description of Artificial Sequence:  Enzymatic Nucleic Acid
ucagaggggccgaaaggcgagucaaggucuagggguac

SEQ ID NO: 1052 - RNA, 38 nt, Artificial Sequence
  Description of Artificial Sequence:  Enzymatic Nucleic Acid
cagggggggccgaaaggcgagucaaggucuaacguagc

SEQ ID NO: 1053 - RNA, 38 nt, Artificial Sequence
  Description of Artificial Sequence:  Enzymatic Nucleic Acid
gggggcuggccgaaaggcgagucaaggucuaggucagg

SEQ ID NO: 1054 - RNA, 38 nt, Artificial Sequence
  Description of Artificial Sequence:  Enzymatic Nucleic Acid
ucucgggggccgaaaggcgagucaaggucugaaggggg

SEQ ID NO: 1055 - RNA, 38 nt, Artificial Sequence
  Description of Artificial Sequence:  Enzymatic Nucleic Acid
gcagcagggccgaaaggcgagucaaggucuagagggcc

SEQ ID NO: 1056 - RNA, 38 nt, Artificial Sequence
  Description of Artificial Sequence:  Enzymatic Nucleic Acid
ucgggcaggccgaaaggcgagucaaggucuaggcagag

SEQ ID NO: 1057 - RNA, 38 nt, Artificial Sequence
  Description of Artificial Sequence:  Enzymatic Nucleic Acid
aggucggggccgaaaggcgagucaaggucuagcaggca

SEQ ID NO: 1058 - RNA, 38 nt, Artificial Sequence
  Description of Artificial Sequence:  Enzymatic Nucleic Acid
ggcaccaggccgaaaggcgagucaaggucuaggucggg

SEQ ID NO: 1059 - RNA, 38 nt, Artificial Sequence
  Description of Artificial Sequence:  Enzymatic Nucleic Acid
cagagugggccgaaaggcgagucaaggucuaccagcag

SEQ ID NO: 1060 - RNA, 38 nt, Artificial Sequence
  Description of Artificial Sequence:  Enzymatic Nucleic Acid
cccaaagggccgaaaggcgagucaaggucuaaaaacgu

SEQ ID NO: 1061 - RNA, 38 nt, Artificial Sequence
  Description of Artificial Sequence:  Enzymatic Nucleic Acid
cuccacgggccgaaaggcgagucaaggucuacccccaa

SEQ ID NO: 1062 - RNA, 38 nt, Artificial Sequence
  Description of Artificial Sequence:  Enzymatic Nucleic Acid
cugagggggccgaaaggcgagucaaggucuagcuccuc

SEQ ID NO: 1063 - RNA, 38 nt, Artificial Sequence
  Description of Artificial Sequence:  Enzymatic Nucleic Acid
gcugaagggccgaaaggcgagucaaggucuaggaggag

SEQ ID NO: 1064 - RNA, 38 nt, Artificial Sequence
  Description of Artificial Sequence:  Enzymatic Nucleic Acid
cacacugggccgaaaggcgagucaaggucuacguccag

SEQ ID NO: 1065 - RNA, 38 nt, Artificial Sequence
  Description of Artificial Sequence:  Enzymatic Nucleic Acid
ggcuucuggccgaaaggcgagucaaggucuggacuugg

SEQ ID NO: 1066 - RNA, 38 nt, Artificial Sequence
  Description of Artificial Sequence:  Enzymatic Nucleic Acid
gaugccaggccgaaaggcgagucaaggucuagaaguca

SEQ ID NO: 1067 - RNA, 38 nt, Artificial Sequence
  Description of Artificial Sequence:  Enzymatic Nucleic Acid
uggcaugggccgaaaggcgagucaaggucuagguuccc

SEQ ID NO: 1068 - RNA, 38 nt, Artificial Sequence
  Description of Artificial Sequence:  Enzymatic Nucleic Acid
guuccugggccgaaaggcgagucaaggucuauggcagg

SEQ ID NO: 1069 - RNA, 38 nt, Artificial Sequence
  Description of Artificial Sequence:  Enzymatic Nucleic Acid
aacucaaggccgaaaggcgagucaaggucuaggaagga

SEQ ID NO: 1070 - RNA, 38 nt, Artificial Sequence
  Description of Artificial Sequence:  Enzymatic Nucleic Acid
ucauuggggccgaaaggcgagucaaggucuagggccuc

SEQ ID NO: 1071 - RNA, 38 nt, Artificial Sequence
  Description of Artificial Sequence:  Enzymatic Nucleic Acid
ggcugugggccgaaaggcgagucaaggucuauccacug

SEQ ID NO: 1072 - RNA, 38 nt, Artificial Sequence
  Description of Artificial Sequence:  Enzymatic Nucleic Acid
augggggggccgaaaggcgagucaaggucuaguacuag

SEQ ID NO: 1073 - RNA, 38 nt, Artificial Sequence
  Description of Artificial Sequence:  Enzymatic Nucleic Acid
cagaaaaggccgaaaggcgagucaaggucuacucugua

SEQ ID NO: 1074 - RNA, 38 nt, Artificial Sequence
  Description of Artificial Sequence:  Enzymatic Nucleic Acid
cagcggcagccgaaaggcgagucaaggucuaaggccgc

SEQ ID NO: 1075 - RNA, 38 nt, Artificial Sequence
  Description of Artificial Sequence:  Enzymatic Nucleic Acid
ccggugcagccgaaaggcgagucaaggucuacuugggu

SEQ ID NO: 1076 - RNA, 38 nt, Artificial Sequence
  Description of Artificial Sequence:  Enzymatic Nucleic Acid
aggaaggagccgaaaggcgagucaaggucuaggcuggc

SEQ ID NO: 1077 - RNA, 38 nt, Artificial Sequence
  Description of Artificial Sequence:  Enzymatic Nucleic Acid
gccucgcagccgaaaggcgagucaaggucuaauccgca

SEQ ID NO: 1078 - RNA, 38 nt, Artificial Sequence
  Description of Artificial Sequence:  Enzymatic Nucleic Acid
cccugugagccgaaaggcgagucaaggucuaggggugg

SEQ ID NO: 1079 - RNA, 38 nt, Artificial Sequence
  Description of Artificial Sequence:  Enzymatic Nucleic Acid
uccuuccagccgaaaggcgagucaaggucuaaaaucgu

SEQ ID NO: 1080 - RNA, 38 nt, Artificial Sequence
  Description of Artificial Sequence:  Enzymatic Nucleic Acid
ucggagaagccgaaaggcgagucaaggucuaggggugg

SEQ ID NO: 1081 - RNA, 38 nt, Artificial Sequence
  Description of Artificial Sequence:  Enzymatic Nucleic Acid
cccuuacagccgaaaggcgagucaaggucuaucggaga

SEQ ID NO: 1082 - RNA, 38 nt, Artificial Sequence
  Description of Artificial Sequence:  Enzymatic Nucleic Acid
agcccuuagccgaaaggcgagucaaggucuacaucgga

SEQ ID NO: 1083 - RNA, 38 nt, Artificial Sequence
  Description of Artificial Sequence:  Enzymatic Nucleic Acid
ggcucugagccgaaaggcgagucaaggucuaauccuca

SEQ ID NO: 1084 - RNA, 38 nt, Artificial Sequence
  Description of Artificial Sequence:  Enzymatic Nucleic Acid
ggcacagagccgaaaggcgagucaaggucuagugcgcg

SEQ ID NO: 1085 - RNA, 38 nt, Artificial Sequence
  Description of Artificial Sequence:  Enzymatic Nucleic Acid
caccggcagccgaaaggcgagucaaggucuagacagug

SEQ ID NO: 1086 - RNA, 38 nt, Artificial Sequence
  Description of Artificial Sequence:  Enzymatic Nucleic Acid
agcgggcagccgaaaggcgagucaaggucuagccaccg

SEQ ID NO: 1087 - RNA, 38 nt, Artificial Sequence
  Description of Artificial Sequence:  Enzymatic Nucleic Acid
cggcagcagccgaaaggcgagucaaggucuacugcuca

SEQ ID NO: 1088 - RNA, 38 nt, Artificial Sequence
  Description of Artificial Sequence:  Enzymatic Nucleic Acid
gcagcucagccgaaaggcgagucaaggucuagaugcca

SEQ ID NO: 1089 - RNA, 38 nt, Artificial Sequence
  Description of Artificial Sequence:  Enzymatic Nucleic Acid
cagucacagccgaaaggcgagucaaggucuagcuggcg

SEQ ID NO: 1090 - RNA, 38 nt, Artificial Sequence
  Description of Artificial Sequence:  Enzymatic Nucleic Acid
ggcagucagccgaaaggcgagucaaggucuacagcugg

SEQ ID NO: 1091 - RNA, 38 nt, Artificial Sequence
  Description of Artificial Sequence:  Enzymatic Nucleic Acid
uguagggagccgaaaggcgagucaaggucuaggcaguc

SEQ ID NO: 1092 - RNA, 38 nt, Artificial Sequence
  Description of Artificial Sequence:  Enzymatic Nucleic Acid
acuucucagccgaaaggcgagucaaggucuaccgcugu

SEQ ID NO: 1093 - RNA, 38 nt, Artificial Sequence
  Description of Artificial Sequence:  Enzymatic Nucleic Acid
cucgggcagccgaaaggcgagucaaggucuagggcuug

SEQ ID NO: 1094 - RNA, 38 nt, Artificial Sequence
  Description of Artificial Sequence:  Enzymatic Nucleic Acid
ccauagcagccgaaaggcgagucaaggucuacucgggc

SEQ ID NO: 1095 - RNA, 38 nt, Artificial Sequence
  Description of Artificial Sequence:  Enzymatic Nucleic Acid
gucucaaagccgaaaggcgagucaaggucuacuuggag

SEQ ID NO: 1096 - RNA, 38 nt, Artificial Sequence
  Description of Artificial Sequence:  Enzymatic Nucleic Acid
cgcccacagccgaaaggcgagucaaggucuacucgucc

SEQ ID NO: 1097 - RNA, 38 nt, Artificial Sequence
  Description of Artificial Sequence:  Enzymatic Nucleic Acid
cucgcccagccgaaaggcgagucaaggucuacacucgu

SEQ ID NO: 1098 - RNA, 38 nt, Artificial Sequence
  Description of Artificial Sequence:  Enzymatic Nucleic Acid
cgggcgcagccgaaaggcgagucaaggucuagcuggug

SEQ ID NO: 1099 - RNA, 38 nt, Artificial Sequence
  Description of Artificial Sequence:  Enzymatic Nucleic Acid
aguugacagccgaaaggcgagucaaggucuacugggug

SEQ ID NO: 1100 - RNA, 38 nt, Artificial Sequence
  Description of Artificial Sequence:  Enzymatic Nucleic Acid
gcaguugagccgaaaggcgagucaaggucuacacuggg

SEQ ID NO: 1101 - RNA, 38 nt, Artificial Sequence
  Description of Artificial Sequence:  Enzymatic Nucleic Acid
ggcauucagccgaaaggcgagucaaggucuauacuccc

SEQ ID NO: 1102 - RNA, 38 nt, Artificial Sequence
  Description of Artificial Sequence:  Enzymatic Nucleic Acid
acggcaaagccgaaaggcgagucaaggucuagugccug

SEQ ID NO: 1103 - RNA, 38 nt, Artificial Sequence
  Description of Artificial Sequence:  Enzymatic Nucleic Acid
ggggcugagccgaaaggcgagucaaggucuacucaggg

SEQ ID NO: 1104 - RNA, 38 nt, Artificial Sequence
  Description of Artificial Sequence:  Enzymatic Nucleic Acid
guccaaaagccgaaaggcgagucaaggucuaggucacu

SEQ ID NO: 1105 - RNA, 38 nt, Artificial Sequence
  Description of Artificial Sequence:  Enzymatic Nucleic Acid
aggccacagccgaaaggcgagucaaggucuacugguca

SEQ ID NO: 1106 - RNA, 38 nt, Artificial Sequence
  Description of Artificial Sequence:  Enzymatic Nucleic Acid
acaggccagccgaaaggcgagucaaggucuacacuggu

SEQ ID NO: 1107 - RNA, 38 nt, Artificial Sequence
  Description of Artificial Sequence:  Enzymatic Nucleic Acid
agugggcagccgaaaggcgagucaaggucuaggccaca

SEQ ID NO: 1108 - RNA, 38 nt, Artificial Sequence
  Description of Artificial Sequence:  Enzymatic Nucleic Acid
agguuucagccgaaaggcgagucaaggucuaccgcugg

SEQ ID NO: 1109 - RNA, 38 nt, Artificial Sequence
  Description of Artificial Sequence:  Enzymatic Nucleic Acid
gguccacagccgaaaggcgagucaaggucuaggagugg

SEQ ID NO: 1110 - RNA, 38 nt, Artificial Sequence
  Description of Artificial Sequence:  Enzymatic Nucleic Acid
cagguccagccgaaaggcgagucaaggucuacaggagu

SEQ ID NO: 1111 - RNA, 38 nt, Artificial Sequence
  Description of Artificial Sequence:  Enzymatic Nucleic Acid
aauuuucagccgaaaggcgagucaaggucuauucuccc

SEQ ID NO: 1112 - RNA, 38 nt, Artificial Sequence
  Description of Artificial Sequence:  Enzymatic Nucleic Acid
ucccucaagccgaaaggcgagucaaggucuacuuugau

SEQ ID NO: 1113 - RNA, 38 nt, Artificial Sequence
  Description of Artificial Sequence:  Enzymatic Nucleic Acid
ggagcccagccgaaaggcgagucaaggucuaccagcca

SEQ ID NO: 1114 - RNA, 38 nt, Artificial Sequence
  Description of Artificial Sequence:  Enzymatic Nucleic Acid
gcgggagagccgaaaggcgagucaaggucuauaugggg

SEQ ID NO: 1115 - RNA, 38 nt, Artificial Sequence
  Description of Artificial Sequence:  Enzymatic Nucleic Acid
uucccggagccgaaaggcgagucaaggucuauggucua

SEQ ID NO: 1116 - RNA, 38 nt, Artificial Sequence
  Description of Artificial Sequence:  Enzymatic Nucleic Acid
ucugcauagccgaaaggcgagucaaggucuaccaguuc

SEQ ID NO: 1117 - RNA, 38 nt, Artificial Sequence
  Description of Artificial Sequence:  Enzymatic Nucleic Acid
gagccgcagccgaaaggcgagucaaggucuauccucca

SEQ ID NO: 1118 - RNA, 38 nt, Artificial Sequence
  Description of Artificial Sequence:  Enzymatic Nucleic Acid
aauuuugagccgaaaggcgagucaaggucuaugguugg

SEQ ID NO: 1119 - RNA, 38 nt, Artificial Sequence
  Description of Artificial Sequence:  Enzymatic Nucleic Acid
acuccacagccgaaaggcgagucaaggucuaucacucu

SEQ ID NO: 1120 - RNA, 38 nt, Artificial Sequence
  Description of Artificial Sequence:  Enzymatic Nucleic Acid
uaacuccagccgaaaggcgagucaaggucuacaucacu

SEQ ID NO: 1121 - RNA, 38 nt, Artificial Sequence
  Description of Artificial Sequence:  Enzymatic Nucleic Acid
cacagucagccgaaaggcgagucaaggucuaccauaac

SEQ ID NO: 1122 - RNA, 38 nt, Artificial Sequence
  Description of Artificial Sequence:  Enzymatic Nucleic Acid
cucccacagccgaaaggcgagucaaggucuagucacac

SEQ ID NO: 1123 - RNA, 38 nt, Artificial Sequence
  Description of Artificial Sequence:  Enzymatic Nucleic Acid
agcucccagccgaaaggcgagucaaggucuacagucac

SEQ ID NO: 1124 - RNA, 38 nt, Artificial Sequence
  Description of Artificial Sequence:  Enzymatic Nucleic Acid
cauguagagccgaaaggcgagucaaggucuaucaaugg

SEQ ID NO: 1125 - RNA, 38 nt, Artificial Sequence
  Description of Artificial Sequence:  Enzymatic Nucleic Acid
ucauccaagccgaaaggcgagucaaggucuauuugacc

SEQ ID NO: 1126 - RNA, 38 nt, Artificial Sequence
  Description of Artificial Sequence:  Enzymatic Nucleic Acid
uuggccgagccgaaaggcgagucaaggucuauucagag

SEQ ID NO: 1127 - RNA, 38 nt, Artificial Sequence
  Description of Artificial Sequence:  Enzymatic Nucleic Acid
aauucagagccgaaaggcgagucaaggucuaccaacuc

SEQ ID NO: 1128 - RNA, 38 nt, Artificial Sequence
  Description of Artificial Sequence:  Enzymatic Nucleic Acid
gaugaccagccgaaaggcgagucaaggucuaaagcgcu

SEQ ID NO: 1129 - RNA, 38 nt, Artificial Sequence
  Description of Artificial Sequence:  Enzymatic Nucleic Acid
ggucuggagccgaaaggcgagucaaggucuagaagaag

SEQ ID NO: 1130 - RNA, 38 nt, Artificial Sequence
  Description of Artificial Sequence:  Enzymatic Nucleic Acid
aucaaauagccgaaaggcgagucaaggucuaucggagc

SEQ ID NO: 1131 - RNA, 38 nt, Artificial Sequence
  Description of Artificial Sequence:  Enzymatic Nucleic Acid
cugguucagccgaaaggcgagucaaggucuauauucag

SEQ ID NO: 1132 - RNA, 38 nt, Artificial Sequence
  Description of Artificial Sequence:  Enzymatic Nucleic Acid
gggccgaagccgaaaggcgagucaaggucuaucuggcu

SEQ ID NO: 1133 - RNA, 38 nt, Artificial Sequence
  Description of Artificial Sequence:  Enzymatic Nucleic Acid
cugguucagccgaaaggcgagucaaggucuacuggcac

SEQ ID NO: 1134 - RNA, 38 nt, Artificial Sequence
  Description of Artificial Sequence:  Enzymatic Nucleic Acid
ugaggacagccgaaaggcgagucaaggucuaucagggc

SEQ ID NO: 1135 - RNA, 38 nt, Artificial Sequence
  Description of Artificial Sequence:  Enzymatic Nucleic Acid
ccugaggagccgaaaggcgagucaaggucuacaucagg

SEQ ID NO: 1136 - RNA, 38 nt, Artificial Sequence
  Description of Artificial Sequence:  Enzymatic Nucleic Acid
ccuuaggagccgaaaggcgagucaaggucuagguuccu

SEQ ID NO: 1137 - RNA, 38 nt, Artificial Sequence
  Description of Artificial Sequence:  Enzymatic Nucleic Acid
agaauccagccgaaaggcgagucaaggucuaaagacuc

SEQ ID NO: 1138 - RNA, 38 nt, Artificial Sequence
  Description of Artificial Sequence:  Enzymatic Nucleic Acid
uucuuagagccgaaaggcgagucaaggucuacucccuu

SEQ ID NO: 1139 - RNA, 38 nt, Artificial Sequence
  Description of Artificial Sequence:  Enzymatic Nucleic Acid
uucagggagccgaaaggcgagucaaggucuagucucug

SEQ ID NO: 1140 - RNA, 38 nt, Artificial Sequence
  Description of Artificial Sequence:  Enzymatic Nucleic Acid
gauacugagccgaaaggcgagucaaggucuaccauugc

SEQ ID NO: 1141 - RNA, 38 nt, Artificial Sequence
  Description of Artificial Sequence:  Enzymatic Nucleic Acid
acucuguagccgaaaggcgagucaaggucuaaagccug

SEQ ID NO: 1142 - RNA, 38 nt, Artificial Sequence
  Description of Artificial Sequence:  Enzymatic Nucleic Acid
aaacuaaagccgaaaggcgagucaaggucuagaaaagc

SEQ ID NO: 1143 - RNA, 38 nt, Artificial Sequence
  Description of Artificial Sequence:  Enzymatic Nucleic Acid
aaacaaaagccgaaaggcgagucaaggucuaaaaaaag

SEQ ID NO: 1144 - RNA, 38 nt, Artificial Sequence
  Description of Artificial Sequence:  Enzymatic Nucleic Acid
uaaaaaaagccgaaaggcgagucaaggucuaaaacaaa

SEQ ID NO: 1145 - RNA, 38 nt, Artificial Sequence
  Description of Artificial Sequence:  Enzymatic Nucleic Acid
caggguuagccgaaaggcgagucaaggucucuccccuu

SEQ ID NO: 1146 - RNA, 38 nt, Artificial Sequence
  Description of Artificial Sequence:  Enzymatic Nucleic Acid
caaagggggccgaaaggcgagucaaggucucaggguua

SEQ ID NO: 1147 - RNA, 38 nt, Artificial Sequence
  Description of Artificial Sequence:  Enzymatic Nucleic Acid
ggccccgagccgaaaggcgagucaaggucucaaagggg

SEQ ID NO: 1148 - RNA, 38 nt, Artificial Sequence
  Description of Artificial Sequence:  Enzymatic Nucleic Acid
gcccgggggccgaaaggcgagucaaggucucccgacca

SEQ ID NO: 1149 - RNA, 38 nt, Artificial Sequence
  Description of Artificial Sequence:  Enzymatic Nucleic Acid
cgcggcuggccgaaaggcgagucaaggucuccggggcc

SEQ ID NO: 1150 - RNA, 38 nt, Artificial Sequence
  Description of Artificial Sequence:  Enzymatic Nucleic Acid
gcgcgcgggccgaaaggcgagucaaggucuugcccggg

SEQ ID NO: 1151 - RNA, 38 nt, Artificial Sequence
  Description of Artificial Sequence:  Enzymatic Nucleic Acid
guaaaggggccgaaaggcgagucaaggucucccguggg

SEQ ID NO: 1152 - RNA, 38 nt, Artificial Sequence
  Description of Artificial Sequence:  Enzymatic Nucleic Acid
gguggggggccgaaaggcgagucaaggucucgggcgcg

SEQ ID NO: 1153 - RNA, 38 nt, Artificial Sequence
  Description of Artificial Sequence:  Enzymatic Nucleic Acid
gcgggguggccgaaaggcgagucaaggucuugcgaggg

SEQ ID NO: 1154 - RNA, 38 nt, Artificial Sequence
  Description of Artificial Sequence:  Enzymatic Nucleic Acid
ggacccgggccgaaaggcgagucaaggucuugggaggg

SEQ ID NO: 1155 - RNA, 38 nt, Artificial Sequence
  Description of Artificial Sequence:  Enzymatic Nucleic Acid
cggcuggagccgaaaggcgagucaaggucuccggcugg

SEQ ID NO: 1156 - RNA, 38 nt, Artificial Sequence
  Description of Artificial Sequence:  Enzymatic Nucleic Acid
ggcuccgggccgaaaggcgagucaaggucuuggacccg

SEQ ID NO: 1157 - RNA, 38 nt, Artificial Sequence
  Description of Artificial Sequence:  Enzymatic Nucleic Acid
ccccaugggccgaaaggcgagucaaggucuuccggcug

SEQ ID NO: 1158 - RNA, 38 nt, Artificial Sequence
  Description of Artificial Sequence:  Enzymatic Nucleic Acid
ggcuccgggccgaaaggcgagucaaggucucccauggc

SEQ ID NO: 1159 - RNA, 38 nt, Artificial Sequence
  Description of Artificial Sequence:  Enzymatic Nucleic Acid
cacugcgggccgaaaggcgagucaaggucuuccggccc

SEQ ID NO: 1160 - RNA, 38 nt, Artificial Sequence
  Description of Artificial Sequence:  Enzymatic Nucleic Acid
ggugcucagccgaaaggcgagucaaggucuugcggcuc

SEQ ID NO: 1161 - RNA, 38 nt, Artificial Sequence
  Description of Artificial Sequence:  Enzymatic Nucleic Acid
ccaugguggccgaaaggcgagucaaggucuucacugcg

SEQ ID NO: 1162 - RNA, 38 nt, Artificial Sequence
  Description of Artificial Sequence:  Enzymatic Nucleic Acid
gccgccaggccgaaaggcgagucaaggucuuccauggu

SEQ ID NO: 1163 - RNA, 38 nt, Artificial Sequence
  Description of Artificial Sequence:  Enzymatic Nucleic Acid
caaggccggccgaaaggcgagucaaggucucagcucca

SEQ ID NO: 1164 - RNA, 38 nt, Artificial Sequence
  Description of Artificial Sequence:  Enzymatic Nucleic Acid
gcacaagggccgaaaggcgagucaaggucucgccagcu

SEQ ID NO: 1165 - RNA, 38 nt, Artificial Sequence
  Description of Artificial Sequence:  Enzymatic Nucleic Acid
aggaggaggccgaaaggcgagucaaggucuccccagcg

SEQ ID NO: 1166 - RNA, 38 nt, Artificial Sequence
  Description of Artificial Sequence:  Enzymatic Nucleic Acid
gcucgcgggccgaaaggcgagucaaggucuuccggggg

SEQ ID NO: 1167 - RNA, 38 nt, Artificial Sequence
  Description of Artificial Sequence:  Enzymatic Nucleic Acid
cuuggguggccgaaaggcgagucaaggucuucgcggcu

SEQ ID NO: 1168 - RNA, 38 nt, Artificial Sequence
  Description of Artificial Sequence:  Enzymatic Nucleic Acid
ggugcacagccgaaaggcgagucaaggucuuugggugc

SEQ ID NO: 1169 - RNA, 38 nt, Artificial Sequence
  Description of Artificial Sequence:  Enzymatic Nucleic Acid
ugucuguggccgaaaggcgagucaaggucucggugcac

SEQ ID NO: 1170 - RNA, 38 nt, Artificial Sequence
  Description of Artificial Sequence:  Enzymatic Nucleic Acid
agccgcaggccgaaaggcgagucaaggucuuucauguc

SEQ ID NO: 1171 - RNA, 38 nt, Artificial Sequence
  Description of Artificial Sequence:  Enzymatic Nucleic Acid
gcagggaggccgaaaggcgagucaaggucucgcagcuu

SEQ ID NO: 1172 - RNA, 38 nt, Artificial Sequence
  Description of Artificial Sequence:  Enzymatic Nucleic Acid
ucucgggagccgaaaggcgagucaaggucuuggcaggg

SEQ ID NO: 1173 - RNA, 38 nt, Artificial Sequence
  Description of Artificial Sequence:  Enzymatic Nucleic Acid
ccuggcaggccgaaaggcgagucaaggucuccugguag

SEQ ID NO: 1174 - RNA, 38 nt, Artificial Sequence
  Description of Artificial Sequence:  Enzymatic Nucleic Acid
cugcaccagccgaaaggcgagucaaggucucuggcagc

SEQ ID NO: 1175 - RNA, 38 nt, Artificial Sequence
  Description of Artificial Sequence:  Enzymatic Nucleic Acid
ucccugcagccgaaaggcgagucaaggucucaccuggc

SEQ ID NO: 1176 - RNA, 38 nt, Artificial Sequence
  Description of Artificial Sequence:  Enzymatic Nucleic Acid
aggacagggccgaaaggcgagucaaggucuuggcauug

SEQ ID NO: 1177 - RNA, 38 nt, Artificial Sequence
  Description of Artificial Sequence:  Enzymatic Nucleic Acid
gcccugcagccgaaaggcgagucaaggucucuccugga

SEQ ID NO: 1178 - RNA, 38 nt, Artificial Sequence
  Description of Artificial Sequence:  Enzymatic Nucleic Acid
gcacguaggccgaaaggcgagucaaggucuccugcacc

SEQ ID NO: 1179 - RNA, 38 nt, Artificial Sequence
  Description of Artificial Sequence:  Enzymatic Nucleic Acid
gaugagcagccgaaaggcgagucaaggucuguagcccu

SEQ ID NO: 1180 - RNA, 38 nt, Artificial Sequence
  Description of Artificial Sequence:  Enzymatic Nucleic Acid
cugccucagccgaaaggcgagucaaggucuuugguugu

SEQ ID NO: 1181 - RNA, 38 nt, Artificial Sequence
  Description of Artificial Sequence:  Enzymatic Nucleic Acid
gggaccuggccgaaaggcgagucaaggucucucacuug

SEQ ID NO: 1182 - RNA, 38 nt, Artificial Sequence
  Description of Artificial Sequence:  Enzymatic Nucleic Acid
cagugggagccgaaaggcgagucaaggucucugccuca

SEQ ID NO: 1183 - RNA, 38 nt, Artificial Sequence
  Description of Artificial Sequence:  Enzymatic Nucleic Acid
auccgcaggccgaaaggcgagucaaggucucucugcag

SEQ ID NO: 1184 - RNA, 38 nt, Artificial Sequence
  Description of Artificial Sequence:  Enzymatic Nucleic Acid
gcuggguggccgaaaggcgagucaaggucucucgcaca

SEQ ID NO: 1185 - RNA, 38 nt, Artificial Sequence
  Description of Artificial Sequence:  Enzymatic Nucleic Acid
ucaaagaggccgaaaggcgagucaaggucuugggugcc

SEQ ID NO: 1186 - RNA, 38 nt, Artificial Sequence
  Description of Artificial Sequence:  Enzymatic Nucleic Acid
uagcacgggccgaaaggcgagucaaggucucagggcau

SEQ ID NO: 1187 - RNA, 38 nt, Artificial Sequence
  Description of Artificial Sequence:  Enzymatic Nucleic Acid
gucuagcagccgaaaggcgagucaaggucuggccaggg

SEQ ID NO: 1188 - RNA, 38 nt, Artificial Sequence
  Description of Artificial Sequence:  Enzymatic Nucleic Acid
uggggagggccgaaaggcgagucaaggucucccuguga

SEQ ID NO: 1189 - RNA, 38 nt, Artificial Sequence
  Description of Artificial Sequence:  Enzymatic Nucleic Acid
cccgcagggccgaaaggcgagucaaggucucuccuggg

SEQ ID NO: 1190 - RNA, 38 nt, Artificial Sequence
  Description of Artificial Sequence:  Enzymatic Nucleic Acid
agcugcaggccgaaaggcgagucaaggucuucccgcag

SEQ ID NO: 1191 - RNA, 38 nt, Artificial Sequence
  Description of Artificial Sequence:  Enzymatic Nucleic Acid
cuucgaaggccgaaaggcgagucaaggucuugcagcuc

SEQ ID NO: 1192 - RNA, 38 nt, Artificial Sequence
  Description of Artificial Sequence:  Enzymatic Nucleic Acid
cugugagggccgaaaggcgagucaaggucuuucgaagc

SEQ ID NO: 1193 - RNA, 38 nt, Artificial Sequence
  Description of Artificial Sequence:  Enzymatic Nucleic Acid
gaucaagagccgaaaggcgagucaaggucucccuccuu

SEQ ID NO: 1194 - RNA, 38 nt, Artificial Sequence
  Description of Artificial Sequence:  Enzymatic Nucleic Acid
ggguuccggccgaaaggcgagucaaggucuuggaucaa

SEQ ID NO: 1195 - RNA, 38 nt, Artificial Sequence
  Description of Artificial Sequence:  Enzymatic Nucleic Acid
uagcagaggccgaaaggcgagucaaggucuuggggguu

SEQ ID NO: 1196 - RNA, 38 nt, Artificial Sequence
  Description of Artificial Sequence:  Enzymatic Nucleic Acid
agagccaggccgaaaggcgagucaaggucuugguuguu

SEQ ID NO: 1197 - RNA, 38 nt, Artificial Sequence
  Description of Artificial Sequence:  Enzymatic Nucleic Acid
ugugagaggccgaaaggcgagucaaggucucagcuggu

SEQ ID NO: 1198 - RNA, 38 nt, Artificial Sequence
  Description of Artificial Sequence:  Enzymatic Nucleic Acid
guggcagggccgaaaggcgagucaaggucuccgagagc

SEQ ID NO: 1199 - RNA, 38 nt, Artificial Sequence
  Description of Artificial Sequence:  Enzymatic Nucleic Acid
agcgggaggccgaaaggcgagucaaggucuccuuacac

SEQ ID NO: 1200 - RNA, 38 nt, Artificial Sequence
  Description of Artificial Sequence:  Enzymatic Nucleic Acid
ccucagaagccgaaaggcgagucaaggucuucucuccc

SEQ ID NO: 1201 - RNA, 38 nt, Artificial Sequence
  Description of Artificial Sequence:  Enzymatic Nucleic Acid
gcgucagggccgaaaggcgagucaaggucuucugacaa

SEQ ID NO: 1202 - RNA, 38 nt, Artificial Sequence
  Description of Artificial Sequence:  Enzymatic Nucleic Acid
cacagccagccgaaaggcgagucaaggucucggcacag

SEQ ID NO: 1203 - RNA, 38 nt, Artificial Sequence
  Description of Artificial Sequence:  Enzymatic Nucleic Acid
gggcacaggccgaaaggcgagucaaggucucaccggca

SEQ ID NO: 1204 - RNA, 38 nt, Artificial Sequence
  Description of Artificial Sequence:  Enzymatic Nucleic Acid
ggcagugggccgaaaggcgagucaaggucucccuugca

SEQ ID NO: 1205 - RNA, 38 nt, Artificial Sequence
  Description of Artificial Sequence:  Enzymatic Nucleic Acid
gcacacuggccgaaaggcgagucaaggucuucauggca

SEQ ID NO: 1206 - RNA, 38 nt, Artificial Sequence
  Description of Artificial Sequence:  Enzymatic Nucleic Acid
gcagcacagccgaaaggcgagucaaggucuugcucaug

SEQ ID NO: 1207 - RNA, 38 nt, Artificial Sequence
  Description of Artificial Sequence:  Enzymatic Nucleic Acid
ccgugcaggccgaaaggcgagucaaggucucggcagca

SEQ ID NO: 1208 - RNA, 38 nt, Artificial Sequence
  Description of Artificial Sequence:  Enzymatic Nucleic Acid
gcuugggggccgaaaggcgagucaaggucuccgugcag

SEQ ID NO: 1209 - RNA, 38 nt, Artificial Sequence
  Description of Artificial Sequence:  Enzymatic Nucleic Acid
ucagaguggccgaaaggcgagucaaggucuuuggggcc

SEQ ID NO: 1210 - RNA, 38 nt, Artificial Sequence
  Description of Artificial Sequence:  Enzymatic Nucleic Acid
gaggcagggccgaaaggcgagucaaggucucaggcagu

SEQ ID NO: 1211 - RNA, 38 nt, Artificial Sequence
  Description of Artificial Sequence:  Enzymatic Nucleic Acid
agaugccagccgaaaggcgagucaaggucuugugguug

SEQ ID NO: 1212 - RNA, 38 nt, Artificial Sequence
  Description of Artificial Sequence:  Enzymatic Nucleic Acid
cacagauggccgaaaggcgagucaaggucucacugugg

SEQ ID NO: 1213 - RNA, 38 nt, Artificial Sequence
  Description of Artificial Sequence:  Enzymatic Nucleic Acid
cagugcaggccgaaaggcgagucaaggucuucacagau

SEQ ID NO: 1214 - RNA, 38 nt, Artificial Sequence
  Description of Artificial Sequence:  Enzymatic Nucleic Acid
gaccaggggccgaaaggcgagucaaggucuugggcagu

SEQ ID NO: 1215 - RNA, 38 nt, Artificial Sequence
  Description of Artificial Sequence:  Enzymatic Nucleic Acid
guaggugagccgaaaggcgagucaaggucucagggcug

SEQ ID NO: 1216 - RNA, 38 nt, Artificial Sequence
  Description of Artificial Sequence:  Enzymatic Nucleic Acid
gacucaaagccgaaaggcgagucaaggucugugucugu

SEQ ID NO: 1217 - RNA, 38 nt, Artificial Sequence
  Description of Artificial Sequence:  Enzymatic Nucleic Acid
ggcauggagccgaaaggcgagucaaggucuucaaacgu

SEQ ID NO: 1218 - RNA, 38 nt, Artificial Sequence
  Description of Artificial Sequence:  Enzymatic Nucleic Acid
uauaccgggccgaaaggcgagucaaggucuccucggga

SEQ ID NO: 1219 - RNA, 38 nt, Artificial Sequence
  Description of Artificial Sequence:  Enzymatic Nucleic Acid
aauguauagccgaaaggcgagucaaggucucggcccuc

SEQ ID NO: 1220 - RNA, 38 nt, Artificial Sequence
  Description of Artificial Sequence:  Enzymatic Nucleic Acid
agcuggcggccgaaaggcgagucaaggucucgaaugua

SEQ ID NO: 1221 - RNA, 38 nt, Artificial Sequence
  Description of Artificial Sequence:  Enzymatic Nucleic Acid
ucacacaggccgaaaggcgagucaaggucuuggcgccg

SEQ ID NO: 1222 - RNA, 38 nt, Artificial Sequence
  Description of Artificial Sequence:  Enzymatic Nucleic Acid
ggaucccagccgaaaggcgagucaaggucuguccguag

SEQ ID NO: 1223 - RNA, 38 nt, Artificial Sequence
  Description of Artificial Sequence:  Enzymatic Nucleic Acid
ggggcagagccgaaaggcgagucaaggucugagggugc

SEQ ID NO: 1224 - RNA, 38 nt, Artificial Sequence
  Description of Artificial Sequence:  Enzymatic Nucleic Acid
ugcugucagccgaaaggcgagucaaggucucucuuggu

SEQ ID NO: 1225 - RNA, 38 nt, Artificial Sequence
  Description of Artificial Sequence:  Enzymatic Nucleic Acid
auccucuggccgaaaggcgagucaaggucuugucaccu

SEQ ID NO: 1226 - RNA, 38 nt, Artificial Sequence
  Description of Artificial Sequence:  Enzymatic Nucleic Acid
ucacaccggccgaaaggcgagucaaggucuuguguucc

SEQ ID NO: 1227 - RNA, 38 nt, Artificial Sequence
  Description of Artificial Sequence:  Enzymatic Nucleic Acid
uucucacagccgaaaggcgagucaaggucucgcugugu

SEQ ID NO: 1228 - RNA, 38 nt, Artificial Sequence
  Description of Artificial Sequence:  Enzymatic Nucleic Acid
uugcugcagccgaaaggcgagucaaggucuuucucaca

SEQ ID NO: 1229 - RNA, 38 nt, Artificial Sequence
  Description of Artificial Sequence:  Enzymatic Nucleic Acid
agggcuuggccgaaaggcgagucaaggucuugcacuuc

SEQ ID NO: 1230 - RNA, 38 nt, Artificial Sequence
  Description of Artificial Sequence:  Enzymatic Nucleic Acid
gcacaggggccgaaaggcgagucaaggucuuugcugca

SEQ ID NO: 1231 - RNA, 38 nt, Artificial Sequence
  Description of Artificial Sequence:  Enzymatic Nucleic Acid
auagcacagccgaaaggcgagucaaggucuucgggcac

SEQ ID NO: 1232 - RNA, 38 nt, Artificial Sequence
  Description of Artificial Sequence:  Enzymatic Nucleic Acid
ugcccagagccgaaaggcgagucaaggucucauagcac

SEQ ID NO: 1233 - RNA, 38 nt, Artificial Sequence
  Description of Artificial Sequence:  Enzymatic Nucleic Acid
gcuccauggccgaaaggcgagucaaggucuccagacca

SEQ ID NO: 1234 - RNA, 38 nt, Artificial Sequence
  Description of Artificial Sequence:  Enzymatic Nucleic Acid
cgcaaguggccgaaaggcgagucaaggucuuccaugcc

SEQ ID NO: 1235 - RNA, 38 nt, Artificial Sequence
  Description of Artificial Sequence:  Enzymatic Nucleic Acid
ugcccucagccgaaaggcgagucaaggucucucucgca

SEQ ID NO: 1236 - RNA, 38 nt, Artificial Sequence
  Description of Artificial Sequence:  Enzymatic Nucleic Acid
gguaacuggccgaaaggcgagucaaggucuccucaccu

SEQ ID NO: 1237 - RNA, 38 nt, Artificial Sequence
  Description of Artificial Sequence:  Enzymatic Nucleic Acid
acugguaagccgaaaggcgagucaaggucuugcccuca

SEQ ID NO: 1238 - RNA, 38 nt, Artificial Sequence
  Description of Artificial Sequence:  Enzymatic Nucleic Acid
uauuggcagccgaaaggcgagucaaggucuugguaacu

SEQ ID NO: 1239 - RNA, 38 nt, Artificial Sequence
  Description of Artificial Sequence:  Enzymatic Nucleic Acid
ccagcaaagccgaaaggcgagucaaggucuuccuggau

SEQ ID NO: 1240 - RNA, 38 nt, Artificial Sequence
  Description of Artificial Sequence:  Enzymatic Nucleic Acid
ucuugcaggccgaaaggcgagucaaggucucagcaaac

SEQ ID NO: 1241 - RNA, 38 nt, Artificial Sequence
  Description of Artificial Sequence:  Enzymatic Nucleic Acid
augccagggccgaaaggcgagucaaggucuucccaaag

SEQ ID NO: 1242 - RNA, 38 nt, Artificial Sequence
  Description of Artificial Sequence:  Enzymatic Nucleic Acid
cagaaauggccgaaaggcgagucaaggucucaggcucc

SEQ ID NO: 1243 - RNA, 38 nt, Artificial Sequence
  Description of Artificial Sequence:  Enzymatic Nucleic Acid
caucaaaggccgaaaggcgagucaaggucuucuccggc

SEQ ID NO: 1244 - RNA, 38 nt, Artificial Sequence
  Description of Artificial Sequence:  Enzymatic Nucleic Acid
guuggagggccgaaaggcgagucaaggucuuggguccc

SEQ ID NO: 1245 - RNA, 38 nt, Artificial Sequence
  Description of Artificial Sequence:  Enzymatic Nucleic Acid
ugcucugggccgaaaggcgagucaaggucuuggagcgg

SEQ ID NO: 1246 - RNA, 38 nt, Artificial Sequence
  Description of Artificial Sequence:  Enzymatic Nucleic Acid
uggagcuggccgaaaggcgagucaaggucuucuggcug

SEQ ID NO: 1247 - RNA, 38 nt, Artificial Sequence
  Description of Artificial Sequence:  Enzymatic Nucleic Acid
acuuggaggccgaaaggcgagucaaggucuugcucugg

SEQ ID NO: 1248 - RNA, 38 nt, Artificial Sequence
  Description of Artificial Sequence:  Enzymatic Nucleic Acid
cucaaacagccgaaaggcgagucaaggucuuuggagcu

SEQ ID NO: 1249 - RNA, 38 nt, Artificial Sequence
  Description of Artificial Sequence:  Enzymatic Nucleic Acid
auagguaagccgaaaggcgagucaaggucucugugauc

SEQ ID NO: 1250 - RNA, 38 nt, Artificial Sequence
  Description of Artificial Sequence:  Enzymatic Nucleic Acid
cggccauggccgaaaggcgagucaaggucuugagaugu

SEQ ID NO: 1251 - RNA, 38 nt, Artificial Sequence
  Description of Artificial Sequence:  Enzymatic Nucleic Acid
cuguccgggccgaaaggcgagucaaggucucaugcuga

SEQ ID NO: 1252 - RNA, 38 nt, Artificial Sequence
  Description of Artificial Sequence:  Enzymatic Nucleic Acid
caggcagggccgaaaggcgagucaaggucuuguccggc

SEQ ID NO: 1253 - RNA, 38 nt, Artificial Sequence
  Description of Artificial Sequence:  Enzymatic Nucleic Acid
ggaagacggccgaaaggcgagucaaggucuugagguca

SEQ ID NO: 1254 - RNA, 38 nt, Artificial Sequence
  Description of Artificial Sequence:  Enzymatic Nucleic Acid
cuggaagagccgaaaggcgagucaaggucugcugaggu

SEQ ID NO: 1255 - RNA, 38 nt, Artificial Sequence
  Description of Artificial Sequence:  Enzymatic Nucleic Acid
ccggauuagccgaaaggcgagucaaggucuuugcaggu

SEQ ID NO: 1256 - RNA, 38 nt, Artificial Sequence
  Description of Artificial Sequence:  Enzymatic Nucleic Acid
aguaggcggccgaaaggcgagucaaggucucauugugc

SEQ ID NO: 1257 - RNA, 38 nt, Artificial Sequence
  Description of Artificial Sequence:  Enzymatic Nucleic Acid
augcccaggccgaaaggcgagucaaggucuccuugcag

SEQ ID NO: 1258 - RNA, 38 nt, Artificial Sequence
  Description of Artificial Sequence:  Enzymatic Nucleic Acid
agcugauggccgaaaggcgagucaaggucuccagcccu

SEQ ID NO: 1259 - RNA, 38 nt, Artificial Sequence
  Description of Artificial Sequence:  Enzymatic Nucleic Acid
ccagccaggccgaaaggcgagucaaggucuugaugccc

SEQ ID NO: 1260 - RNA, 38 nt, Artificial Sequence
  Description of Artificial Sequence:  Enzymatic Nucleic Acid
agccccaggccgaaaggcgagucaaggucucagcugau

SEQ ID NO: 1261 - RNA, 38 nt, Artificial Sequence
  Description of Artificial Sequence:  Enzymatic Nucleic Acid
gagcgcaggccgaaaggcgagucaaggucucccagcca

SEQ ID NO: 1262 - RNA, 38 nt, Artificial Sequence
  Description of Artificial Sequence:  Enzymatic Nucleic Acid
guccacuggccgaaaggcgagucaaggucuccaguucc

SEQ ID NO: 1263 - RNA, 38 nt, Artificial Sequence
  Description of Artificial Sequence:  Enzymatic Nucleic Acid
ccaguccagccgaaaggcgagucaaggucuugcccagu

SEQ ID NO: 1264 - RNA, 38 nt, Artificial Sequence
  Description of Artificial Sequence:  Enzymatic Nucleic Acid
gaugaggggccgaaaggcgagucaaggucucaguccac

SEQ ID NO: 1265 - RNA, 38 nt, Artificial Sequence
  Description of Artificial Sequence:  Enzymatic Nucleic Acid
cgugugcagccgaaaggcgagucaaggucugaagcaga

SEQ ID NO: 1266 - RNA, 38 nt, Artificial Sequence
  Description of Artificial Sequence:  Enzymatic Nucleic Acid
ccagggcagccgaaaggcgagucaaggucucgugugca

SEQ ID NO: 1267 - RNA, 38 nt, Artificial Sequence
  Description of Artificial Sequence:  Enzymatic Nucleic Acid
cgaaagaggccgaaaggcgagucaaggucuugguccca

SEQ ID NO: 1268 - RNA, 38 nt, Artificial Sequence
  Description of Artificial Sequence:  Enzymatic Nucleic Acid
gagcagaggccgaaaggcgagucaaggucuuuggugcg

SEQ ID NO: 1269 - RNA, 38 nt, Artificial Sequence
  Description of Artificial Sequence:  Enzymatic Nucleic Acid
uccucugggccgaaaggcgagucaaggucucgguuggc

SEQ ID NO: 1270 - RNA, 38 nt, Artificial Sequence
  Description of Artificial Sequence:  Enzymatic Nucleic Acid
cccacacagccgaaaggcgagucaaggucuucguccuc

SEQ ID NO: 1271 - RNA, 38 nt, Artificial Sequence
  Description of Artificial Sequence:  Enzymatic Nucleic Acid
ggcccucggccgaaaggcgagucaaggucuccacacac

SEQ ID NO: 1272 - RNA, 38 nt, Artificial Sequence
  Description of Artificial Sequence:  Enzymatic Nucleic Acid
aggccagggccgaaaggcgagucaaggucuccucgccc

SEQ ID NO: 1273 - RNA, 38 nt, Artificial Sequence
  Description of Artificial Sequence:  Enzymatic Nucleic Acid
guggcagggccgaaaggcgagucaaggucucaggcccu

SEQ ID NO: 1274 - RNA, 38 nt, Artificial Sequence
  Description of Artificial Sequence:  Enzymatic Nucleic Acid
gcgcacaggccgaaaggcgagucaaggucuugguggca

SEQ ID NO: 1275 - RNA, 38 nt, Artificial Sequence
  Description of Artificial Sequence:  Enzymatic Nucleic Acid
cagcaguggccgaaaggcgagucaaggucuccucgggc

SEQ ID NO: 1276 - RNA, 38 nt, Artificial Sequence
  Description of Artificial Sequence:  Enzymatic Nucleic Acid
gcccuggagccgaaaggcgagucaaggucucccagcag

SEQ ID NO: 1277 - RNA, 38 nt, Artificial Sequence
  Description of Artificial Sequence:  Enzymatic Nucleic Acid
uggguggggccgaaaggcgagucaaggucuccuggacc

SEQ ID NO: 1278 - RNA, 38 nt, Artificial Sequence
  Description of Artificial Sequence:  Enzymatic Nucleic Acid
uugacacagccgaaaggcgagucaaggucuuggguggg

SEQ ID NO: 1279 - RNA, 38 nt, Artificial Sequence
  Description of Artificial Sequence:  Enzymatic Nucleic Acid
ggaacugggccgaaaggcgagucaaggucuugcaguug

SEQ ID NO: 1280 - RNA, 38 nt, Artificial Sequence
  Description of Artificial Sequence:  Enzymatic Nucleic Acid
cgaaggaagccgaaaggcgagucaaggucuuggcugca

SEQ ID NO: 1281 - RNA, 38 nt, Artificial Sequence
  Description of Artificial Sequence:  Enzymatic Nucleic Acid
acuccugggccgaaaggcgagucaaggucucccgaagg

SEQ ID NO: 1282 - RNA, 38 nt, Artificial Sequence
  Description of Artificial Sequence:  Enzymatic Nucleic Acid
uccacgcagccgaaaggcgagucaaggucuuccuggcc

SEQ ID NO: 1283 - RNA, 38 nt, Artificial Sequence
  Description of Artificial Sequence:  Enzymatic Nucleic Acid
uuccuccagccgaaaggcgagucaaggucugcacuccu

SEQ ID NO: 1284 - RNA, 38 nt, Artificial Sequence
  Description of Artificial Sequence:  Enzymatic Nucleic Acid
cugcaguagccgaaaggcgagucaaggucuucggcauu

SEQ ID NO: 1285 - RNA, 38 nt, Artificial Sequence
  Description of Artificial Sequence:  Enzymatic Nucleic Acid
cuggggaggccgaaaggcgagucaaggucucccugcag

SEQ ID NO: 1286 - RNA, 38 nt, Artificial Sequence
  Description of Artificial Sequence:  Enzymatic Nucleic Acid
uucacauagccgaaaggcgagucaaggucuucccuggg

SEQ ID NO: 1287 - RNA, 38 nt, Artificial Sequence
  Description of Artificial Sequence:  Enzymatic Nucleic Acid
aaacaguggccgaaaggcgagucaaggucucuggcauu

SEQ ID NO: 1288 - RNA, 38 nt, Artificial Sequence
  Description of Artificial Sequence:  Enzymatic Nucleic Acid
ggguggcagccgaaaggcgagucaaggucuggcaaaca

SEQ ID NO: 1289 - RNA, 38 nt, Artificial Sequence
  Description of Artificial Sequence:  Enzymatic Nucleic Acid
ggcugacagccgaaaggcgagucaaggucuucagggug

SEQ ID NO: 1290 - RNA, 38 nt, Artificial Sequence
  Description of Artificial Sequence:  Enzymatic Nucleic Acid
uucugggggccgaaaggcgagucaaggucuugacacuc

SEQ ID NO: 1291 - RNA, 38 nt, Artificial Sequence
  Description of Artificial Sequence:  Enzymatic Nucleic Acid
ucacugaggccgaaaggcgagucaaggucucauucugg

SEQ ID NO: 1292 - RNA, 38 nt, Artificial Sequence
  Description of Artificial Sequence:  Enzymatic Nucleic Acid
acaggucagccgaaaggcgagucaaggucuugagccau

SEQ ID NO: 1293 - RNA, 38 nt, Artificial Sequence
  Description of Artificial Sequence:  Enzymatic Nucleic Acid
cuggucaggccgaaaggcgagucaaggucucuccgguc

SEQ ID NO: 1294 - RNA, 38 nt, Artificial Sequence
  Description of Artificial Sequence:  Enzymatic Nucleic Acid
gccacacagccgaaaggcgagucaaggucuuggucagc

SEQ ID NO: 1295 - RNA, 38 nt, Artificial Sequence
  Description of Artificial Sequence:  Enzymatic Nucleic Acid
ggcacagggccgaaaggcgagucaaggucucacacacu

SEQ ID NO: 1296 - RNA, 38 nt, Artificial Sequence
  Description of Artificial Sequence:  Enzymatic Nucleic Acid
gcgggccagccgaaaggcgagucaaggucugcagaagg

SEQ ID NO: 1297 - RNA, 38 nt, Artificial Sequence
  Description of Artificial Sequence:  Enzymatic Nucleic Acid
gcagcggggccgaaaggcgagucaaggucucacgcaga

SEQ ID NO: 1298 - RNA, 38 nt, Artificial Sequence
  Description of Artificial Sequence:  Enzymatic Nucleic Acid
ucacaccggccgaaaggcgagucaaggucuuggggcag

SEQ ID NO: 1299 - RNA, 38 nt, Artificial Sequence
  Description of Artificial Sequence:  Enzymatic Nucleic Acid
guuucacagccgaaaggcgagucaaggucucgcugggg

SEQ ID NO: 1300 - RNA, 38 nt, Artificial Sequence
  Description of Artificial Sequence:  Enzymatic Nucleic Acid
ucuggaaagccgaaaggcgagucaaggucuuuccagau

SEQ ID NO: 1301 - RNA, 38 nt, Artificial Sequence
  Description of Artificial Sequence:  Enzymatic Nucleic Acid
ggcaugcggccgaaaggcgagucaaggucuccuccuca

SEQ ID NO: 1302 - RNA, 38 nt, Artificial Sequence
  Description of Artificial Sequence:  Enzymatic Nucleic Acid
gggcaagggccgaaaggcgagucaaggucuuggcaugc

SEQ ID NO: 1303 - RNA, 38 nt, Artificial Sequence
  Description of Artificial Sequence:  Enzymatic Nucleic Acid
cggggcaggccgaaaggcgagucaaggucuccuuguca

SEQ ID NO: 1304 - RNA, 38 nt, Artificial Sequence
  Description of Artificial Sequence:  Enzymatic Nucleic Acid
gcucucuggccgaaaggcgagucaaggucuucggcggg

SEQ ID NO: 1305 - RNA, 38 nt, Artificial Sequence
  Description of Artificial Sequence:  Enzymatic Nucleic Acid
agggcugggccgaaaggcgagucaaggucuucucugcu

SEQ ID NO: 1306 - RNA, 38 nt, Artificial Sequence
  Description of Artificial Sequence:  Enzymatic Nucleic Acid
ucagaggggccgaaaggcgagucaaggucuuggcucuc

SEQ ID NO: 1307 - RNA, 38 nt, Artificial Sequence
  Description of Artificial Sequence:  Enzymatic Nucleic Acid
augauggagccgaaaggcgagucaaggucugucagagg

SEQ ID NO: 1308 - RNA, 38 nt, Artificial Sequence
  Description of Artificial Sequence:  Enzymatic Nucleic Acid
gccaaccagccgaaaggcgagucaaggucucgcagaga

SEQ ID NO: 1309 - RNA, 38 nt, Artificial Sequence
  Description of Artificial Sequence:  Enzymatic Nucleic Acid
aaugccaagccgaaaggcgagucaaggucucaccgcag

SEQ ID NO: 1310 - RNA, 38 nt, Artificial Sequence
  Description of Artificial Sequence:  Enzymatic Nucleic Acid
gcagaauggccgaaaggcgagucaaggucucaaccacc

SEQ ID NO: 1311 - RNA, 38 nt, Artificial Sequence
  Description of Artificial Sequence:  Enzymatic Nucleic Acid
gaccacgagccgaaaggcgagucaaggucucagcagaa

SEQ ID NO: 1312 - RNA, 38 nt, Artificial Sequence
  Description of Artificial Sequence:  Enzymatic Nucleic Acid
caagaccagccgaaaggcgagucaaggucugaccagca

SEQ ID NO: 1313 - RNA, 38 nt, Artificial Sequence
  Description of Artificial Sequence:  Enzymatic Nucleic Acid
ccccaagagccgaaaggcgagucaaggucucacgacca

SEQ ID NO: 1314 - RNA, 38 nt, Artificial Sequence
  Description of Artificial Sequence:  Enzymatic Nucleic Acid
aaagaccagccgaaaggcgagucaaggucuccccaaga

SEQ ID NO: 1315 - RNA, 38 nt, Artificial Sequence
  Description of Artificial Sequence:  Enzymatic Nucleic Acid
cccaaagagccgaaaggcgagucaaggucucaccccca

SEQ ID NO: 1316 - RNA, 38 nt, Artificial Sequence
  Description of Artificial Sequence:  Enzymatic Nucleic Acid
ugccgucggccgaaaggcgagucaaggucuuugaugag

SEQ ID NO: 1317 - RNA, 38 nt, Artificial Sequence
  Description of Artificial Sequence:  Enzymatic Nucleic Acid
uucugcuggccgaaaggcgagucaaggucucgucgcuu

SEQ ID NO: 1318 - RNA, 38 nt, Artificial Sequence
  Description of Artificial Sequence:  Enzymatic Nucleic Acid
aucuucuggccgaaaggcgagucaaggucuugccgucg

SEQ ID NO: 1319 - RNA, 38 nt, Artificial Sequence
  Description of Artificial Sequence:  Enzymatic Nucleic Acid
aucguguagccgaaaggcgagucaaggucuuuccggau

SEQ ID NO: 1320 - RNA, 38 nt, Artificial Sequence
  Description of Artificial Sequence:  Enzymatic Nucleic Acid
uccaccaggccgaaaggcgagucaaggucuuccguuuc

SEQ ID NO: 1321 - RNA, 38 nt, Artificial Sequence
  Description of Artificial Sequence:  Enzymatic Nucleic Acid
cggcuccagccgaaaggcgagucaaggucucagcuccg

SEQ ID NO: 1322 - RNA, 38 nt, Artificial Sequence
  Description of Artificial Sequence:  Enzymatic Nucleic Acid
gucagcgggccgaaaggcgagucaaggucuuccaccag

SEQ ID NO: 1323 - RNA, 38 nt, Artificial Sequence
  Description of Artificial Sequence:  Enzymatic Nucleic Acid
ucgcuccggccgaaaggcgagucaaggucuuagguguc

SEQ ID NO: 1324 - RNA, 38 nt, Artificial Sequence
  Description of Artificial Sequence:  Enzymatic Nucleic Acid
gggcaucggccgaaaggcgagucaaggucuuccgcuag

SEQ ID NO: 1325 - RNA, 38 nt, Artificial Sequence
  Description of Artificial Sequence:  Enzymatic Nucleic Acid
caucugcggccgaaaggcgagucaaggucucugguugg

SEQ ID NO: 1326 - RNA, 38 nt, Artificial Sequence
  Description of Artificial Sequence:  Enzymatic Nucleic Acid
uuccucaggccgaaaggcgagucaaggucuuccgucuc

SEQ ID NO: 1327 - RNA, 38 nt, Artificial Sequence
  Description of Artificial Sequence:  Enzymatic Nucleic Acid
caccuucagccgaaaggcgagucaaggucucuuccuca

SEQ ID NO: 1328 - RNA, 38 nt, Artificial Sequence
  Description of Artificial Sequence:  Enzymatic Nucleic Acid
uccaagcagccgaaaggcgagucaaggucucuucaccu

SEQ ID NO: 1329 - RNA, 38 nt, Artificial Sequence
  Description of Artificial Sequence:  Enzymatic Nucleic Acid
caaaagcggccgaaaggcgagucaaggucucagaucca

SEQ ID NO: 1330 - RNA, 38 nt, Artificial Sequence
  Description of Artificial Sequence:  Enzymatic Nucleic Acid
agacuguggccgaaaggcgagucaaggucucaaaagcg

SEQ ID NO: 1331 - RNA, 38 nt, Artificial Sequence
  Description of Artificial Sequence:  Enzymatic Nucleic Acid
cuuguagagccgaaaggcgagucaaggucuugugccaa

SEQ ID NO: 1332 - RNA, 38 nt, Artificial Sequence
  Description of Artificial Sequence:  Enzymatic Nucleic Acid
uccagauggccgaaaggcgagucaaggucuccuuguag

SEQ ID NO: 1333 - RNA, 38 nt, Artificial Sequence
  Description of Artificial Sequence:  Enzymatic Nucleic Acid
gauggccagccgaaaggcgagucaaggucuuggaauuu

SEQ ID NO: 1334 - RNA, 38 nt, Artificial Sequence
  Description of Artificial Sequence:  Enzymatic Nucleic Acid
uuugaugggccgaaaggcgagucaaggucucacuggaa

SEQ ID NO: 1335 - RNA, 38 nt, Artificial Sequence
  Description of Artificial Sequence:  Enzymatic Nucleic Acid
ccucaacagccgaaaggcgagucaaggucuuuugaugg

SEQ ID NO: 1336 - RNA, 38 nt, Artificial Sequence
  Description of Artificial Sequence:  Enzymatic Nucleic Acid
uuuguugggccgaaaggcgagucaaggucuuuuggggg

SEQ ID NO: 1337 - RNA, 38 nt, Artificial Sequence
  Description of Artificial Sequence:  Enzymatic Nucleic Acid
cacguauggccgaaaggcgagucaaggucuuucgucua

SEQ ID NO: 1338 - RNA, 38 nt, Artificial Sequence
  Description of Artificial Sequence:  Enzymatic Nucleic Acid
agccaucagccgaaaggcgagucaaggucuguaugcuu

SEQ ID NO: 1339 - RNA, 38 nt, Artificial Sequence
  Description of Artificial Sequence:  Enzymatic Nucleic Acid
cacaccaggccgaaaggcgagucaaggucucaucacgu

SEQ ID NO: 1340 - RNA, 38 nt, Artificial Sequence
  Description of Artificial Sequence:  Enzymatic Nucleic Acid
agcccacagccgaaaggcgagucaaggucucagccauc

SEQ ID NO: 1341 - RNA, 38 nt, Artificial Sequence
  Description of Artificial Sequence:  Enzymatic Nucleic Acid
auggggaggccgaaaggcgagucaaggucuccacacca

SEQ ID NO: 1342 - RNA, 38 nt, Artificial Sequence
  Description of Artificial Sequence:  Enzymatic Nucleic Acid
ggcagauggccgaaaggcgagucaaggucuccagaagg

SEQ ID NO: 1343 - RNA, 38 nt, Artificial Sequence
  Description of Artificial Sequence:  Enzymatic Nucleic Acid
cagcugcagccgaaaggcgagucaaggucucguggaug

SEQ ID NO: 1344 - RNA, 38 nt, Artificial Sequence
  Description of Artificial Sequence:  Enzymatic Nucleic Acid
gucaccaggccgaaaggcgagucaaggucuugcaccgu

SEQ ID NO: 1345 - RNA, 38 nt, Artificial Sequence
  Description of Artificial Sequence:  Enzymatic Nucleic Acid
cugugucagccgaaaggcgagucaaggucucagcugca

SEQ ID NO: 1346 - RNA, 38 nt, Artificial Sequence
  Description of Artificial Sequence:  Enzymatic Nucleic Acid
ggcauaaggccgaaaggcgagucaaggucuugugucac

SEQ ID NO: 1347 - RNA, 38 nt, Artificial Sequence
  Description of Artificial Sequence:  Enzymatic Nucleic Acid
agaggcaggccgaaaggcgagucaaggucucauagggc

SEQ ID NO: 1348 - RNA, 38 nt, Artificial Sequence
  Description of Artificial Sequence:  Enzymatic Nucleic Acid
ccugggaggccgaaaggcgagucaaggucuccaggcgu

SEQ ID NO: 1349 - RNA, 38 nt, Artificial Sequence
  Description of Artificial Sequence:  Enzymatic Nucleic Acid
ugcauacagccgaaaggcgagucaaggucucaguucag

SEQ ID NO: 1350 - RNA, 38 nt, Artificial Sequence
  Description of Artificial Sequence:  Enzymatic Nucleic Acid
ccagguaggccgaaaggcgagucaaggucuucaucccc

SEQ ID NO: 1351 - RNA, 38 nt, Artificial Sequence
  Description of Artificial Sequence:  Enzymatic Nucleic Acid
uguacgaggccgaaaggcgagucaaggucucgcacauc

SEQ ID NO: 1352 - RNA, 38 nt, Artificial Sequence
  Description of Artificial Sequence:  Enzymatic Nucleic Acid
ccuguguagccgaaaggcgagucaaggucugagccgca

SEQ ID NO: 1353 - RNA, 38 nt, Artificial Sequence
  Description of Artificial Sequence:  Enzymatic Nucleic Acid
ccgagcgggccgaaaggcgagucaaggucucaaguccc

SEQ ID NO: 1354 - RNA, 38 nt, Artificial Sequence
  Description of Artificial Sequence:  Enzymatic Nucleic Acid
gaccagcagccgaaaggcgagucaaggucuguuccgag

SEQ ID NO: 1355 - RNA, 38 nt, Artificial Sequence
  Description of Artificial Sequence:  Enzymatic Nucleic Acid
acucuugagccgaaaggcgagucaaggucucagcacgu

SEQ ID NO: 1356 - RNA, 38 nt, Artificial Sequence
  Description of Artificial Sequence:  Enzymatic Nucleic Acid
gguugggagccgaaaggcgagucaaggucuucuugacc

SEQ ID NO: 1357 - RNA, 38 nt, Artificial Sequence
  Description of Artificial Sequence:  Enzymatic Nucleic Acid
cgagccaggccgaaaggcgagucaaggucuccgaaguc

SEQ ID NO: 1358 - RNA, 38 nt, Artificial Sequence
  Description of Artificial Sequence:  Enzymatic Nucleic Acid
cagccgaggccgaaaggcgagucaaggucucagcccga

SEQ ID NO: 1359 - RNA, 38 nt, Artificial Sequence
  Description of Artificial Sequence:  Enzymatic Nucleic Acid
uccagcaggccgaaaggcgagucaaggucucgagccag

SEQ ID NO: 1360 - RNA, 38 nt, Artificial Sequence
  Description of Artificial Sequence:  Enzymatic Nucleic Acid
gcaugguagccgaaaggcgagucaaggucuucugucuc

SEQ ID NO: 1361 - RNA, 38 nt, Artificial Sequence
  Description of Artificial Sequence:  Enzymatic Nucleic Acid
gcaccuuggccgaaaggcgagucaaggucuccccaucu

SEQ ID NO: 1362 - RNA, 38 nt, Artificial Sequence
  Description of Artificial Sequence:  Enzymatic Nucleic Acid
gaugggcagccgaaaggcgagucaaggucucuugcccc

SEQ ID NO: 1363 - RNA, 38 nt, Artificial Sequence
  Description of Artificial Sequence:  Enzymatic Nucleic Acid
gccauccagccgaaaggcgagucaaggucuuugauggg

SEQ ID NO: 1364 - RNA, 38 nt, Artificial Sequence
  Description of Artificial Sequence:  Enzymatic Nucleic Acid
cuccagcggccgaaaggcgagucaaggucucauccacu

SEQ ID NO: 1365 - RNA, 38 nt, Artificial Sequence
  Description of Artificial Sequence:  Enzymatic Nucleic Acid
agaauggagccgaaaggcgagucaaggucuuccagcgc

SEQ ID NO: 1366 - RNA, 38 nt, Artificial Sequence
  Description of Artificial Sequence:  Enzymatic Nucleic Acid
gugaaccggccgaaaggcgagucaaggucucggcggag

SEQ ID NO: 1367 - RNA, 38 nt, Artificial Sequence
  Description of Artificial Sequence:  Enzymatic Nucleic Acid
ugggugaagccgaaaggcgagucaaggucucgccggcg

SEQ ID NO: 1368 - RNA, 38 nt, Artificial Sequence
  Description of Artificial Sequence:  Enzymatic Nucleic Acid
acacaucagccgaaaggcgagucaaggucuucuggugg

SEQ ID NO: 1369 - RNA, 38 nt, Artificial Sequence
  Description of Artificial Sequence:  Enzymatic Nucleic Acid
caccauaagccgaaaggcgagucaaggucuuccacaca

SEQ ID NO: 1370 - RNA, 38 nt, Artificial Sequence
  Description of Artificial Sequence:  Enzymatic Nucleic Acid
cagucacagccgaaaggcgagucaaggucucauaacuc

SEQ ID NO: 1371 - RNA, 38 nt, Artificial Sequence
  Description of Artificial Sequence:  Enzymatic Nucleic Acid
gucaucaggccgaaaggcgagucaaggucuucccacac

SEQ ID NO: 1372 - RNA, 38 nt, Artificial Sequence
  Description of Artificial Sequence:  Enzymatic Nucleic Acid
agguuugggccgaaaggcgagucaaggucucccaaaag

SEQ ID NO: 1373 - RNA, 38 nt, Artificial Sequence
  Description of Artificial Sequence:  Enzymatic Nucleic Acid
cucccggggccgaaaggcgagucaaggucuugggaucc

SEQ ID NO: 1374 - RNA, 38 nt, Artificial Sequence
  Description of Artificial Sequence:  Enzymatic Nucleic Acid
ggcagccggccgaaaggcgagucaaggucuucccccuu

SEQ ID NO: 1375 - RNA, 38 nt, Artificial Sequence
  Description of Artificial Sequence:  Enzymatic Nucleic Acid
uggggcaggccgaaaggcgagucaaggucucgcucccc

SEQ ID NO: 1376 - RNA, 38 nt, Artificial Sequence
  Description of Artificial Sequence:  Enzymatic Nucleic Acid
augggggggccgaaaggcgagucaaggucuuggggcag

SEQ ID NO: 1377 - RNA, 38 nt, Artificial Sequence
  Description of Artificial Sequence:  Enzymatic Nucleic Acid
acauuugagccgaaaggcgagucaaggucucaugauca

SEQ ID NO: 1378 - RNA, 38 nt, Artificial Sequence
  Description of Artificial Sequence:  Enzymatic Nucleic Acid
aaucuugggccgaaaggcgagucaaggucucgacauuc

SEQ ID NO: 1379 - RNA, 38 nt, Artificial Sequence
  Description of Artificial Sequence:  Enzymatic Nucleic Acid
gacaccaagccgaaaggcgagucaaggucuucccggaa

SEQ ID NO: 1380 - RNA, 38 nt, Artificial Sequence
  Description of Artificial Sequence:  Enzymatic Nucleic Acid
uucagacagccgaaaggcgagucaaggucucaacuccc

SEQ ID NO: 1381 - RNA, 38 nt, Artificial Sequence
  Description of Artificial Sequence:  Enzymatic Nucleic Acid
gucccugggccgaaaggcgagucaaggucucaugcggg

SEQ ID NO: 1382 - RNA, 38 nt, Artificial Sequence
  Description of Artificial Sequence:  Enzymatic Nucleic Acid
acaaagcggccgaaaggcgagucaaggucuuggggguc

SEQ ID NO: 1383 - RNA, 38 nt, Artificial Sequence
  Description of Artificial Sequence:  Enzymatic Nucleic Acid
cuggaugagccgaaaggcgagucaaggucucacaaagc

SEQ ID NO: 1384 - RNA, 38 nt, Artificial Sequence
  Description of Artificial Sequence:  Enzymatic Nucleic Acid
uggcuggggccgaaaggcgagucaaggucuccaagucc

SEQ ID NO: 1385 - RNA, 38 nt, Artificial Sequence
  Description of Artificial Sequence:  Enzymatic Nucleic Acid
gggacugggccgaaaggcgagucaaggucuugggccca

SEQ ID NO: 1386 - RNA, 38 nt, Artificial Sequence
  Description of Artificial Sequence:  Enzymatic Nucleic Acid
ccaagggagccgaaaggcgagucaaggucuuggcuggg

SEQ ID NO: 1387 - RNA, 38 nt, Artificial Sequence
  Description of Artificial Sequence:  Enzymatic Nucleic Acid
agaagguggccgaaaggcgagucaaggucuuguccaag

SEQ ID NO: 1388 - RNA, 38 nt, Artificial Sequence
  Description of Artificial Sequence:  Enzymatic Nucleic Acid
agcauccagccgaaaggcgagucaaggucucagguccc

SEQ ID NO: 1389 - RNA, 38 nt, Artificial Sequence
  Description of Artificial Sequence:  Enzymatic Nucleic Acid
accagauagccgaaaggcgagucaaggucuuccucagc

SEQ ID NO: 1390 - RNA, 38 nt, Artificial Sequence
  Description of Artificial Sequence:  Enzymatic Nucleic Acid
cugggguagccgaaaggcgagucaaggucucagauacu

SEQ ID NO: 1391 - RNA, 38 nt, Artificial Sequence
  Description of Artificial Sequence:  Enzymatic Nucleic Acid
aagcccuggccgaaaggcgagucaaggucuugggguac

SEQ ID NO: 1392 - RNA, 38 nt, Artificial Sequence
  Description of Artificial Sequence:  Enzymatic Nucleic Acid
agaagaaggccgaaaggcgagucaaggucuccugcugg

SEQ ID NO: 1393 - RNA, 38 nt, Artificial Sequence
  Description of Artificial Sequence:  Enzymatic Nucleic Acid
ccccagcggccgaaaggcgagucaaggucuccggggca

SEQ ID NO: 1394 - RNA, 38 nt, Artificial Sequence
  Description of Artificial Sequence:  Enzymatic Nucleic Acid
ggaccauggccgaaaggcgagucaaggucuccccagcg

SEQ ID NO: 1395 - RNA, 38 nt, Artificial Sequence
  Description of Artificial Sequence:  Enzymatic Nucleic Acid
gugguggagccgaaaggcgagucaaggucucaugcccc

SEQ ID NO: 1396 - RNA, 38 nt, Artificial Sequence
  Description of Artificial Sequence:  Enzymatic Nucleic Acid
cugcgguggccgaaaggcgagucaaggucucuguggug

SEQ ID NO: 1397 - RNA, 38 nt, Artificial Sequence
  Description of Artificial Sequence:  Enzymatic Nucleic Acid
uagaugaggccgaaaggcgagucaaggucuugcggugc

SEQ ID NO: 1398 - RNA, 38 nt, Artificial Sequence
  Description of Artificial Sequence:  Enzymatic Nucleic Acid
caccgccagccgaaaggcgagucaaggucuuccuggua

SEQ ID NO: 1399 - RNA, 38 nt, Artificial Sequence
  Description of Artificial Sequence:  Enzymatic Nucleic Acid
ccccaccggccgaaaggcgagucaaggucucacuccug

SEQ ID NO: 1400 - RNA, 38 nt, Artificial Sequence
  Description of Artificial Sequence:  Enzymatic Nucleic Acid
gguccccagccgaaaggcgagucaaggucucgccacuc

SEQ ID NO: 1401 - RNA, 38 nt, Artificial Sequence
  Description of Artificial Sequence:  Enzymatic Nucleic Acid
ggcuccaggccgaaaggcgagucaaggucuccuagugu

SEQ ID NO: 1402 - RNA, 38 nt, Artificial Sequence
  Description of Artificial Sequence:  Enzymatic Nucleic Acid
ucagaggggccgaaaggcgagucaaggucuuccagccc

SEQ ID NO: 1403 - RNA, 38 nt, Artificial Sequence
  Description of Artificial Sequence:  Enzymatic Nucleic Acid
ccuggggggccgaaaggcgagucaaggucucuccucuu

SEQ ID NO: 1404 - RNA, 38 nt, Artificial Sequence
  Description of Artificial Sequence:  Enzymatic Nucleic Acid
aguggagagccgaaaggcgagucaaggucucugggggc

SEQ ID NO: 1405 - RNA, 38 nt, Artificial Sequence
  Description of Artificial Sequence:  Enzymatic Nucleic Acid
ggaggguggccgaaaggcgagucaaggucucaguggag

SEQ ID NO: 1406 - RNA, 38 nt, Artificial Sequence
  Description of Artificial Sequence:  Enzymatic Nucleic Acid
ggagccaggccgaaaggcgagucaaggucucccuucgg

SEQ ID NO: 1407 - RNA, 38 nt, Artificial Sequence
  Description of Artificial Sequence:  Enzymatic Nucleic Acid
caucggaggccgaaaggcgagucaaggucucagccccu

SEQ ID NO: 1408 - RNA, 38 nt, Artificial Sequence
  Description of Artificial Sequence:  Enzymatic Nucleic Acid
ccaggucagccgaaaggcgagucaaggucucaucaaau

SEQ ID NO: 1409 - RNA, 38 nt, Artificial Sequence
  Description of Artificial Sequence:  Enzymatic Nucleic Acid
cuuggcuggccgaaaggcgagucaaggucuccccauuc

SEQ ID NO: 1410 - RNA, 38 nt, Artificial Sequence
  Description of Artificial Sequence:  Enzymatic Nucleic Acid
ccccuugggccgaaaggcgagucaaggucuugccccca

SEQ ID NO: 1411 - RNA, 38 nt, Artificial Sequence
  Description of Artificial Sequence:  Enzymatic Nucleic Acid
cuuugcaggccgaaaggcgagucaaggucucccuuggc

SEQ ID NO: 1412 - RNA, 38 nt, Artificial Sequence
  Description of Artificial Sequence:  Enzymatic Nucleic Acid
uggggagggccgaaaggcgagucaaggucuuuugcagc

SEQ ID NO: 1413 - RNA, 38 nt, Artificial Sequence
  Description of Artificial Sequence:  Enzymatic Nucleic Acid
guagaggggccgaaaggcgagucaaggucuugggguca

SEQ ID NO: 1414 - RNA, 38 nt, Artificial Sequence
  Description of Artificial Sequence:  Enzymatic Nucleic Acid
cuguaccggccgaaaggcgagucaaggucuuguagagg

SEQ ID NO: 1415 - RNA, 38 nt, Artificial Sequence
  Description of Artificial Sequence:  Enzymatic Nucleic Acid
ucacuguagccgaaaggcgagucaaggucucgcuguag

SEQ ID NO: 1416 - RNA, 38 nt, Artificial Sequence
  Description of Artificial Sequence:  Enzymatic Nucleic Acid
gguccucagccgaaaggcgagucaaggucuuguaccgc

SEQ ID NO: 1417 - RNA, 38 nt, Artificial Sequence
  Description of Artificial Sequence:  Enzymatic Nucleic Acid
cagggguagccgaaaggcgagucaaggucuuguggggu

SEQ ID NO: 1418 - RNA, 38 nt, Artificial Sequence
  Description of Artificial Sequence:  Enzymatic Nucleic Acid
caacguaggccgaaaggcgagucaaggucucaucaguc

SEQ ID NO: 1419 - RNA, 38 nt, Artificial Sequence
  Description of Artificial Sequence:  Enzymatic Nucleic Acid
gggggcaagccgaaaggcgagucaaggucuguagccau

SEQ ID NO: 1420 - RNA, 38 nt, Artificial Sequence
  Description of Artificial Sequence:  Enzymatic Nucleic Acid
gcuggggggccgaaaggcgagucaaggucuugcagguc

SEQ ID NO: 1421 - RNA, 38 nt, Artificial Sequence
  Description of Artificial Sequence:  Enzymatic Nucleic Acid
uauucagggccgaaaggcgagucaaggucuugggggcu

SEQ ID NO: 1422 - RNA, 38 nt, Artificial Sequence
  Description of Artificial Sequence:  Enzymatic Nucleic Acid
acaucugggccgaaaggcgagucaaggucuugguucac

SEQ ID NO: 1423 - RNA, 38 nt, Artificial Sequence
  Description of Artificial Sequence:  Enzymatic Nucleic Acid
ggcugggggccgaaaggcgagucaaggucucgaacauc

SEQ ID NO: 1424 - RNA, 38 nt, Artificial Sequence
  Description of Artificial Sequence:  Enzymatic Nucleic Acid
gaaggggggccgaaaggcgagucaaggucuuggggccg

SEQ ID NO: 1425 - RNA, 38 nt, Artificial Sequence
  Description of Artificial Sequence:  Enzymatic Nucleic Acid
gcagaggggccgaaaggcgagucaaggucuccucucgg

SEQ ID NO: 1426 - RNA, 38 nt, Artificial Sequence
  Description of Artificial Sequence:  Enzymatic Nucleic Acid
gaguggcagccgaaaggcgagucaaggucucagcaggu

SEQ ID NO: 1427 - RNA, 38 nt, Artificial Sequence
  Description of Artificial Sequence:  Enzymatic Nucleic Acid
gucuuggggccgaaaggcgagucaaggucucuuuccag

SEQ ID NO: 1428 - RNA, 38 nt, Artificial Sequence
  Description of Artificial Sequence:  Enzymatic Nucleic Acid
uuugacgagccgaaaggcgagucaaggucucccauucu

SEQ ID NO: 1429 - RNA, 38 nt, Artificial Sequence
  Description of Artificial Sequence:  Enzymatic Nucleic Acid
gucuuugagccgaaaggcgagucaaggucugaccccau

SEQ ID NO: 1430 - RNA, 38 nt, Artificial Sequence
  Description of Artificial Sequence:  Enzymatic Nucleic Acid
ggcaaaaagccgaaaggcgagucaaggucugucuuuga

SEQ ID NO: 1431 - RNA, 38 nt, Artificial Sequence
  Description of Artificial Sequence:  Enzymatic Nucleic Acid
ccacggcagccgaaaggcgagucaaggucuccccaaag

SEQ ID NO: 1432 - RNA, 38 nt, Artificial Sequence
  Description of Artificial Sequence:  Enzymatic Nucleic Acid
guucuccagccgaaaggcgagucaaggucuggcacccc

SEQ ID NO: 1433 - RNA, 38 nt, Artificial Sequence
  Description of Artificial Sequence:  Enzymatic Nucleic Acid
gucaaguagccgaaaggcgagucaaggucuucgggguu

SEQ ID NO: 1434 - RNA, 38 nt, Artificial Sequence
  Description of Artificial Sequence:  Enzymatic Nucleic Acid
aggggcaggccgaaaggcgagucaaggucuuccucccu

SEQ ID NO: 1435 - RNA, 38 nt, Artificial Sequence
  Description of Artificial Sequence:  Enzymatic Nucleic Acid
gggugggggccgaaaggcgagucaaggucuugaggggc

SEQ ID NO: 1436 - RNA, 38 nt, Artificial Sequence
  Description of Artificial Sequence:  Enzymatic Nucleic Acid
aggcuggggccgaaaggcgagucaaggucuugaaggca

SEQ ID NO: 1437 - RNA, 38 nt, Artificial Sequence
  Description of Artificial Sequence:  Enzymatic Nucleic Acid
gucgaagggccgaaaggcgagucaaggucuugggcuga

SEQ ID NO: 1438 - RNA, 38 nt, Artificial Sequence
  Description of Artificial Sequence:  Enzymatic Nucleic Acid
gccccccggccgaaaggcgagucaaggucuucuggugg

SEQ ID NO: 1439 - RNA, 38 nt, Artificial Sequence
  Description of Artificial Sequence:  Enzymatic Nucleic Acid
ggguggaggccgaaaggcgagucaaggucucccccgcu

SEQ ID NO: 1440 - RNA, 38 nt, Artificial Sequence
  Description of Artificial Sequence:  Enzymatic Nucleic Acid
ugaagguggccgaaaggcgagucaaggucuugggugga

SEQ ID NO: 1441 - RNA, 38 nt, Artificial Sequence
  Description of Artificial Sequence:  Enzymatic Nucleic Acid
guucucuggccgaaaggcgagucaaggucucguaggug

SEQ ID NO: 1442 - RNA, 38 nt, Artificial Sequence
  Description of Artificial Sequence:  Enzymatic Nucleic Acid
cccagguagccgaaaggcgagucaaggucuucuggguu

SEQ ID NO: 1443 - RNA, 38 nt, Artificial Sequence
  Description of Artificial Sequence:  Enzymatic Nucleic Acid
cguccagagccgaaaggcgagucaaggucuccagguac

SEQ ID NO: 1444 - RNA, 38 nt, Artificial Sequence
  Description of Artificial Sequence:  Enzymatic Nucleic Acid
cacuggcagccgaaaggcgagucaaggucuguccagac

SEQ ID NO: 1445 - RNA, 38 nt, Artificial Sequence
  Description of Artificial Sequence:  Enzymatic Nucleic Acid
gguucacagccgaaaggcgagucaaggucuuggcacgu

SEQ ID NO: 1446 - RNA, 38 nt, Artificial Sequence
  Description of Artificial Sequence:  Enzymatic Nucleic Acid
ggacuugggccgaaaggcgagucaaggucucuucuggu

SEQ ID NO: 1447 - RNA, 38 nt, Artificial Sequence
  Description of Artificial Sequence:  Enzymatic Nucleic Acid
ucugcggagccgaaaggcgagucaaggucuuuggccuu

SEQ ID NO: 1448 - RNA, 38 nt, Artificial Sequence
  Description of Artificial Sequence:  Enzymatic Nucleic Acid
caucaggggccgaaaggcgagucaaggucuuucugcgg

SEQ ID NO: 1449 - RNA, 38 nt, Artificial Sequence
  Description of Artificial Sequence:  Enzymatic Nucleic Acid
cuucccuggccgaaaggcgagucaaggucuucccugag

SEQ ID NO: 1450 - RNA, 38 nt, Artificial Sequence
  Description of Artificial Sequence:  Enzymatic Nucleic Acid
aagucagggccgaaaggcgagucaaggucucuucccug

SEQ ID NO: 1451 - RNA, 38 nt, Artificial Sequence
  Description of Artificial Sequence:  Enzymatic Nucleic Acid
ucuugauggccgaaaggcgagucaaggucucagcagaa

SEQ ID NO: 1452 - RNA, 38 nt, Artificial Sequence
  Description of Artificial Sequence:  Enzymatic Nucleic Acid
cccucccagccgaaaggcgagucaaggucucucuugau

SEQ ID NO: 1453 - RNA, 38 nt, Artificial Sequence
  Description of Artificial Sequence:  Enzymatic Nucleic Acid
ucggaggggccgaaaggcgagucaaggucuccucccac

SEQ ID NO: 1454 - RNA, 38 nt, Artificial Sequence
  Description of Artificial Sequence:  Enzymatic Nucleic Acid
ucugggaagccgaaaggcgagucaaggucuucaagcag

SEQ ID NO: 1455 - RNA, 38 nt, Artificial Sequence
  Description of Artificial Sequence:  Enzymatic Nucleic Acid
ccuuccaggccgaaaggcgagucaaggucucaucuggg

SEQ ID NO: 1456 - RNA, 38 nt, Artificial Sequence
  Description of Artificial Sequence:  Enzymatic Nucleic Acid
aggcuggagccgaaaggcgagucaaggucucccuucca

SEQ ID NO: 1457 - RNA, 38 nt, Artificial Sequence
  Description of Artificial Sequence:  Enzymatic Nucleic Acid
caacgagggccgaaaggcgagucaaggucuuggacccc

SEQ ID NO: 1458 - RNA, 38 nt, Artificial Sequence
  Description of Artificial Sequence:  Enzymatic Nucleic Acid
ucuuccaagccgaaaggcgagucaaggucugaggcugg

SEQ ID NO: 1459 - RNA, 38 nt, Artificial Sequence
  Description of Artificial Sequence:  Enzymatic Nucleic Acid
ccccaguggccgaaaggcgagucaaggucuuguuccuc

SEQ ID NO: 1460 - RNA, 38 nt, Artificial Sequence
  Description of Artificial Sequence:  Enzymatic Nucleic Acid
cacaaagagccgaaaggcgagucaaggucuuccccagu

SEQ ID NO: 1461 - RNA, 38 nt, Artificial Sequence
  Description of Artificial Sequence:  Enzymatic Nucleic Acid
gggcaggggccgaaaggcgagucaaggucucucagaau

SEQ ID NO: 1462 - RNA, 38 nt, Artificial Sequence
  Description of Artificial Sequence:  Enzymatic Nucleic Acid
ccacuggagccgaaaggcgagucaaggucuccuagagu

SEQ ID NO: 1463 - RNA, 38 nt, Artificial Sequence
  Description of Artificial Sequence:  Enzymatic Nucleic Acid
ggcauccagccgaaaggcgagucaaggucuuggacccu

SEQ ID NO: 1464 - RNA, 38 nt, Artificial Sequence
  Description of Artificial Sequence:  Enzymatic Nucleic Acid
aagcuggggccgaaaggcgagucaaggucuuguggcau

SEQ ID NO: 1465 - RNA, 38 nt, Artificial Sequence
  Description of Artificial Sequence:  Enzymatic Nucleic Acid
gggccaaggccgaaaggcgagucaaggucuugggcugu

SEQ ID NO: 1466 - RNA, 38 nt, Artificial Sequence
  Description of Artificial Sequence:  Enzymatic Nucleic Acid
ggaaaggggccgaaaggcgagucaaggucucaagcugg

SEQ ID NO: 1467 - RNA, 38 nt, Artificial Sequence
  Description of Artificial Sequence:  Enzymatic Nucleic Acid
uuucaguagccgaaaggcgagucaaggucuccaggauc

SEQ ID NO: 1468 - RNA, 38 nt, Artificial Sequence
  Description of Artificial Sequence:  Enzymatic Nucleic Acid
cccuaagggccgaaaggcgagucaaggucuuuucagua

SEQ ID NO: 1469 - RNA, 38 nt, Artificial Sequence
  Description of Artificial Sequence:  Enzymatic Nucleic Acid
caggccaggccgaaaggcgagucaaggucuuucccuaa

SEQ ID NO: 1470 - RNA, 38 nt, Artificial Sequence
  Description of Artificial Sequence:  Enzymatic Nucleic Acid
cucucagggccgaaaggcgagucaaggucucagcuucc

SEQ ID NO: 1471 - RNA, 38 nt, Artificial Sequence
  Description of Artificial Sequence:  Enzymatic Nucleic Acid
uagggccggccgaaaggcgagucaaggucuuuccccuc

SEQ ID NO: 1472 - RNA, 38 nt, Artificial Sequence
  Description of Artificial Sequence:  Enzymatic Nucleic Acid
ccuuaggggccgaaaggcgagucaaggucucgcuuccc

SEQ ID NO: 1473 - RNA, 38 nt, Artificial Sequence
  Description of Artificial Sequence:  Enzymatic Nucleic Acid
cuuagacagccgaaaggcgagucaaggucuucccuuag

SEQ ID NO: 1474 - RNA, 38 nt, Artificial Sequence
  Description of Artificial Sequence:  Enzymatic Nucleic Acid
augggucggccgaaaggcgagucaaggucuuuuuguuc

SEQ ID NO: 1475 - RNA, 38 nt, Artificial Sequence
  Description of Artificial Sequence:  Enzymatic Nucleic Acid
gggcaguagccgaaaggcgagucaaggucuuagguuuc

SEQ ID NO: 1476 - RNA, 38 nt, Artificial Sequence
  Description of Artificial Sequence:  Enzymatic Nucleic Acid
caccauuggccgaaaggcgagucaaggucuuguuccuu

SEQ ID NO: 1477 - RNA, 38 nt, Artificial Sequence
  Description of Artificial Sequence:  Enzymatic Nucleic Acid
uacugacagccgaaaggcgagucaaggucucauugcug

SEQ ID NO: 1478 - RNA, 38 nt, Artificial Sequence
  Description of Artificial Sequence:  Enzymatic Nucleic Acid
ccuggauagccgaaaggcgagucaaggucuugacacca

SEQ ID NO: 1479 - RNA, 38 nt, Artificial Sequence
  Description of Artificial Sequence:  Enzymatic Nucleic Acid
guacaaaggccgaaaggcgagucaaggucucuggauac

SEQ ID NO: 1480 - RNA, 38 nt, Artificial Sequence
  Description of Artificial Sequence:  Enzymatic Nucleic Acid
gaaaagcagccgaaaggcgagucaaggucuucuguaca

SEQ ID NO: 1481 - RNA, 38 nt, Artificial Sequence
  Description of Artificial Sequence:  Enzymatic Nucleic Acid
aguaaaaagccgaaaggcgagucaaggucuuaaacaga

SEQ ID NO: 1482 - RNA, 22 nt, Artificial Sequence
  Description of Artificial Sequence:  Enzymatic Nucleic Acid
gccguggguugcacaccuuucc

SEQ ID NO: 1483 - RNA, 22 nt, Artificial Sequence
  Description of Artificial Sequence:  Enzymatic Nucleic Acid
gccgaggguugcacaccuuucc

SEQ ID NO: 1484 - RNA, 22 nt, Artificial Sequence
  Description of Artificial Sequence:  Enzymatic Nucleic Acid
gccgcggguugcacaccuuucc

SEQ ID NO: 1485 - RNA, 22 nt, Artificial Sequence
  Description of Artificial Sequence:  Enzymatic Nucleic Acid
gccggggguugcacaccuuucc

SEQ ID NO: 1486 - RNA, 22 nt, Artificial Sequence
  Description of Artificial Sequence:  Enzymatic Nucleic Acid
gccguugguugcacaccuuucc

SEQ ID NO: 1487 - RNA, 22 nt, Artificial Sequence
  Description of Artificial Sequence:  Enzymatic Nucleic Acid
gccguagguugcacaccuuucc

SEQ ID NO: 1488 - RNA, 22 nt, Artificial Sequence
  Description of Artificial Sequence:  Enzymatic Nucleic Acid
gccgucgguugcacaccuuucc

SEQ ID NO: 1489 - RNA, 22 nt, Artificial Sequence
  Description of Artificial Sequence:  Enzymatic Nucleic Acid
gccguguguugcacaccuuucc

SEQ ID NO: 1490 - RNA, 22 nt, Artificial Sequence
  Description of Artificial Sequence:  Enzymatic Nucleic Acid
gccgugaguugcacaccuuucc

SEQ ID NO: 1491 - RNA, 22 nt, Artificial Sequence
  Description of Artificial Sequence:  Enzymatic Nucleic Acid
gccgugcguugcacaccuuucc

SEQ ID NO: 1492 - RNA, 20 nt, Artificial Sequence
  Description of Artificial Sequence:  Enzymatic Nucleic Acid
gccguggguugcacaccuuu

SEQ ID NO: 1493 - RNA, 18 nt, Artificial Sequence
  Description of Artificial Sequence:  Enzymatic Nucleic Acid
gccguggguugcacaccu

SEQ ID NO: 1494 - RNA, 16 nt, Artificial Sequence
  Description of Artificial Sequence:  Enzymatic Nucleic Acid
gccguggguugcacac

SEQ ID NO: 1495 - RNA, 48 nt, Artificial Sequence
  Description of Artificial Sequence:  Enzymatic Nucleic Acid
  misc_feature (1)..(8): 2'-O-Methyl
  misc_feature (12)..(21): 2'-O-Methyl
  misc_feature (32)..(37): 2'-O-Methyl
  misc_feature (44)..(48): 2'-O-Methyl
  misc_feature (9)..(10): 2'-deoxy-2'-amino
  misc_feature (22)..(26): 2'-deoxy-2'-amino
  misc_feature (38)..(40): 2'-deoxy-2'-amino
gugugcaaccggaggaaacucccuucaaggacgaaaguccgggacggg

SEQ ID NO: 1496 - RNA, 33 nt, Artificial Sequence
  Description of Artificial Sequence:  Substrate for Class II Enzymatic Nucleic Acid
gaagucacggacgcggcgcgagcgagggucagg

SEQ ID NO: 1497 - RNA, 73 nt, Artificial Sequence
  Description of Artificial Sequence:  Enzymatic Nucleic Acid
  misc_feature (21)..(21): 2'-deoxy-2'-amino
  misc_feature (32)..(33): 2'-deoxy-2'-amino
  misc_feature (41)..(41): 2'-deoxy-2'-amino
  misc_feature (46)..(46): 2'-deoxy-2'-amino
  misc_feature (52)..(52): 2'-deoxy-2'-amino
gggaggaggaagugccuggucauaggauuuuccuuuguggcgagucaaggucugccgcgcucgcucccagucc

SEQ ID NO: 1498 - RNA, 73 nt, Artificial Sequence
  Description of Artificial Sequence:  Enzymatic Nucleic Acid
  misc_feature (20)..(20): 2'-deoxy-2'-amino
  misc_feature (23)..(23): 2'-deoxy-2'-amino
  misc_feature (26)..(26): 2'-deoxy-2'-amino
  misc_feature (30)..(31): 2'-deoxy-2'-amino
  misc_feature (41)..(41): 2'-deoxy-2'-amino
  misc_feature (46)..(46): 2'-deoxy-2'-amino
  misc_feature (52)..(52): 2'-deoxy-2'-amino
gggaggaggaagugccuggcuucgucaaaccgauaguaagcgagucaaggucugccgcgcucgcucccagucc

SEQ ID NO: 1499 - RNA, 72 nt, Artificial Sequence
  Description of Artificial Sequence:  Enzymatic Nucleic Acid
  misc_feature (21)..(22): 2'-deoxy-2'-amino
  misc_feature (28)..(28): 2'-deoxy-2'-amino
  misc_feature (33)..(33): 2'-deoxy-2'-amino
  misc_feature (38)..(38): 2'-deoxy-2'-amino
  misc_feature (42)..(42): 2'-deoxy-2'-amino
  misc_feature (44)..(44): 2'-deoxy-2'-amino
  misc_feature (50)..(51): 2'-deoxy-2'-amino
gggaggaggaagugccugguccuguaacuauacagggcagacgcggaaaccugccgcgcucgcucccagucc

SEQ ID NO: 1500 - RNA, 73 nt, Artificial Sequence
  Description of Artificial Sequence:  Enzymatic Nucleic Acid
  misc_feature (20)..(20): 2'-deoxy-2'-amino
  misc_feature (23)..(23): 2'-deoxy-2'-amino
  misc_feature (29)..(29): 2'-deoxy-2'-amino
  misc_feature (37)..(37): 2'-deoxy-2'-amino
  misc_feature (39)..(39): 2'-deoxy-2'-amino
  misc_feature (46)..(46): 2'-deoxy-2'-amino
  misc_feature (51)..(52): 2'-deoxy-2'-amino
gggaggaggaagugccuggcgacugauacgaaaagucgcagauuucgaaaccugccgcgcucgcucccagucc

SEQ ID NO: 1501 - RNA, 70 nt, Artificial Sequence
  Description of Artificial Sequence:  Enzymatic Nucleic Acid
  misc_feature (20)..(20): 2'-deoxy-2'-amino
  misc_feature (22)..(22): 2'-deoxy-2'-amino
  misc_feature (25)..(25): 2'-deoxy-2'-amino
  misc_feature (36)..(36): 2'-deoxy-2'-amino
  misc_feature (43)..(43): 2'-deoxy-2'-amino
  misc_feature (46)..(46): 2'-deoxy-2'-amino
  misc_feature (48)..(49): 2'-deoxy-2'-amino
gggaggaggaagugccuggcucagcauaaagugagcagauugcgacaccugccgcgcucgcucccagucc

SEQ ID NO: 1502 - RNA, 32 nt, Artificial Sequence
  Description of Artificial Sequence:  Substrate for Class II Enzymatic Nucleic Acid
gaagucacggcgcggcgcgagcgagggucagg

SEQ ID NO: 1503 - RNA, 72 nt, Artificial Sequence
  Description of Artificial Sequence:  Enzymatic Nucleic Acid
  misc_feature (31)..(31): 2'-deoxy-2'-amino
  misc_feature (35)..(35): 2'-deoxy-2'-amino
  misc_feature (38)..(38): 2'-deoxy-2'-amino
  misc_feature (42)..(42): 2'-deoxy-2'-amino
  misc_feature (45)..(45): 2'-deoxy-2'-amino
  misc_feature (48)..(48): 2'-deoxy-2'-amino
  misc_feature (50)..(50): 2'-deoxy-2'-amino
gggaggaggaagugccuugguaguaagaaacaugcugcaaacugcgacacuugccgcgcucgcucccagucc

SEQ ID NO: 1504 - RNA, 15 nt, Artificial Sequence
  Description of Artificial Sequence:  Substrate for Class II Enzymatic Nucleic Acid
gcgcggygyaggcac

SEQ ID NO: 1505 - RNA, 35 nt, Artificial Sequence
  Description of Artificial Sequence:  Enzymatic Nucleic Acid
  misc_feature (1)..(7): 2'-O-Methyl
  misc_feature (9)..(15): 2'-O-Methyl
  misc_feature (19)..(19): 2'-O-Methyl
  misc_feature (21)..(21): 2'-O-Methyl
  misc_feature (23)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (38)..(40): 2'-deoxy-2'-amino
  misc_feature (35)..(35): 3'-end phosphate attached to an inverted deoxyabasic moiety, in a 3'-3 orientation
gugccuggccgaaaggcgagugaggucugccgcgc

SEQ ID NO: 1506 - RNA, 61 nt, Artificial Sequence
  Description of Artificial Sequence:  Enzymatic Nucleic Acid
  misc_feature (8)..(8): 2'-deoxy-2'-amino
  misc_feature (10)..(10): 2'-deoxy-2'-amino
  misc_feature (12)..(12): 2'-deoxy-2'-amino
  misc_feature (15)..(16): 2'-deoxy-2'-amino
  misc_feature (19)..(19): 2'-deoxy-2'-amino
  misc_feature (21)..(22): 2'-deoxy-2'-amino
  misc_feature (24)..(25): 2'-deoxy-2'-amino
  misc_feature (27)..(27): 2'-deoxy-2'-amino
  misc_feature (30)..(30): 2'-deoxy-2'-amino
  misc_feature (33)..(33): 2'-deoxy-2'-amino
  misc_feature (35)..(40): 2'-deoxy-2'-amino
  misc_feature (46)..(46): 2'-deoxy-2'-amino
  misc_feature (48)..(49): 2'-deoxy-2'-amino
  misc_feature (51)..(53): 2'-deoxy-2'-amino
  misc_feature (58)..(58): 2'-deoxy-2'-amino
  misc_feature (61)..(61): 2'-deoxy-2'-amino
ggaaaggugugcaaccggugucaucauaauggcacccuucaaggacaucguccgggacggc

SEQ ID NO: 1507 - RNA, 32 nt, Artificial Sequence
  Description of Artificial Sequence:  Enzymatic Nucleic Acid
  misc_feature (2)..(11): 2'-O-Methyl
  misc_feature (12)..(16): 2'-deoxy-2'-amino
  misc_feature (24)..(24): 2'-deoxy-2'-amino
  misc_feature (27)..(29): 2'-deoxy-2'-amino
ggaggaaacucccuucaaggacaucguccggg

SEQ ID NO: 1508 - RNA, 21 nt, Artificial Sequence
  Description of Artificial Sequence:  Enzymatic Nucleic Acid
  misc_feature (1)..(5): 2'-O-Methyl
  misc_feature (12)..(17): 2'-O-Methyl
  misc_feature (3)..(3): 3'-end attachment to hexaethylene glycol spacer
  misc_feature (4)..(4): 5'-end attachment to hexaethylene glycol spacer
  misc_feature (15)..(15): 3'-end attachment to hexaethylene glycol spacer
  misc_feature (16)..(16): 5'-end attachement to hexaethylene glycol spacer
  misc_feature (6)..(10): 2'-deoxy-2'-amino
  misc_feature (18)..(18): 2'-deoxy-2'-amino
ggaucccuucaaggauccggg

SEQ ID NO: 1509 - RNA, 15 nt, Artificial Sequence
  Description of Artificial Sequence:  Substrate for Class II Enzymatic Nucleic Acid
gcgcggcgcaggcac

SEQ ID NO: 1510 - RNA, 36 nt, Artificial Sequence
  Description of Artificial Sequence:  Enzymatic Nucleic Acid
  misc_feature (1)..(8): 2'-O-Methyl
  misc_feature (10)..(16): 2'-O-Methyl
  misc_feature (18)..(21): 2'-O-Methyl
  misc_feature (23)..(27): 2'-O-Methyl
  misc_feature (29)..(36): 2'-O-Methyl
  misc_feature (9)..(9): 2'-deoxy-2'-amino
  misc_feature (17)..(17): 2'-deoxy-2'-amino
  misc_feature (22)..(22): 2'-deoxy-2'-amino
  misc_feature (28)..(28): 2'-deoxy-2'-amino
gugccuggccgaaaggcgagucaaggucugccgcgc

SEQ ID NO: 1511 - RNA, 35 nt, Artificial Sequence; identical to SEQ ID NO: 1505
  Description of Artificial Sequence:  Enzymatic Nucleic Acid
  misc_feature (1)..(15): 2'-O-Methyl
  misc_feature (17)..(18): 2'-O-Methyl
  misc_feature (20)..(23): 2'-O-Methyl
  misc_feature (26)..(26): 2'-O-Methyl
  misc_feature (28)..(34): 2'-O-Methyl
  misc_feature (16)..(16): 2'-deoxy-2'-amino
  misc_feature (27)..(27): 2'-deoxy-2'-amino
  misc_feature (35)..(35): 3'-end phosphate attached to an inverted deoxyabasic moiety, in a 3'-3 orientation

SEQ ID NO: 1512 - RNA, 35 nt, Artificial Sequence; identical to SEQ ID NO: 1505
  Description of Artificial Sequence:  Enzymatic Nucleic Acid
  misc_feature (1)..(14): 2'-O-Methyl
  misc_feature (17)..(18): 2'-O-Methyl
  misc_feature (20)..(22): 2'-O-Methyl
  misc_feature (25)..(25): 2'-O-Methyl
  misc_feature (27)..(33): 2'-O-Methyl
  misc_feature (16)..(16): 2'-deoxy-2'-amino
  misc_feature (26)..(26): 2'-deoxy-2'-amino
  misc_feature (35)..(35): 3'-end phosphate attached to an inverted deoxyabasic moiety, in a 3'-3 orientation

SEQ ID NO: 1513 - RNA, 35 nt, Artificial Sequence; identical to SEQ ID NO: 1505
  Description of Artificial Sequence:  Enzymatic Nucleic Acid
  misc_feature (1)..(14): 2'-O-Methyl
  misc_feature (17)..(18): 2'-O-Methyl
  misc_feature (20)..(22): 2'-O-Methyl
  misc_feature (25)..(25): 2'-O-Methyl
  misc_feature (27)..(33): 2'-O-Methyl
  misc_feature (16)..(16): 2'-deoxy-2'-amino
  misc_feature (26)..(26): 2'-deoxy-2'-amino
  misc_feature (35)..(35): 3'-end phosphate attached to an inverted deoxyabasic moiety, in a 3'-3 orientation

SEQ ID NO: 1514 - RNA, 35 nt, Artificial Sequence; identical to SEQ ID NO: 1505
  Description of Artificial Sequence:  Enzymatic Nucleic Acid
  misc_feature (1)..(15): 2'-O-Methyl
  misc_feature (18)..(22): 2'-O-Methyl
  misc_feature (25)..(25): 2'-O-Methyl
  misc_feature (27)..(33): 2'-O-Methyl
  misc_feature (16)..(16): 2'-deoxy-2'-amino
  misc_feature (26)..(26): 2'-deoxy-2'-amino
  misc_feature (35)..(35): 3'-end phosphate attached to an inverted deoxyabasic moiety, in a 3'-3 orientation

SEQ ID NO: 1515 - RNA, 22 nt, Artificial Sequence
  Description of Artificial Sequence:  Enzymatic Nucleic Acid
gccguggguugcacaccuuucc

SEQ ID NO: 1516 - RNA, 16 nt, Artificial Sequence
  Description of Artificial Sequence:  Enzymatic Nucleic Acid
gguugcacaccuuucc

SEQ ID NO: 1517 - RNA, 73 nt, Artificial Sequence
  Description of Artificial Sequence:  Enzymatic Nucleic Acid
  misc_feature (18)..(52): n stands for any a, c, g, or u
gggaggaggaagugccunnnnnnnnnnnnnnnnnnnnnnnnnnnnnnnnnnnugccgcgcucgcucccagucc

SEQ ID NO: 1518 - RNA, 33 nt, Artificial Sequence
  Description of Artificial Sequence:  Enzymatic Nucleic Acid
  misc_feature (33)..(33): 3'-end phosphate attached to an inverted deoxyabasic moiety, in a 3'-3 orientation
ggacugggagcgagcgcggcgcaggcacugaag

SEQ ID NO: 1519 - RNA, 12 nt, Artificial Sequence
  Description of Artificial Sequence:  Enzymatic Nucleic Acid
  misc_feature (1)..(1): 2'-deoxy-2'-amino
  misc_feature (11)..(11): 2'-deoxy-2'-amino
  misc_feature (6)..(6): n stands for any a, c, g, or u
cgagunaggucu

SEQ ID NO: 1520 - DNA, 73 bp, Artificial Sequence
  Description of Artificial Sequence:  Template
  misc_feature (18)..(58): n stands for any a, c, g, or t
accctcactaaaggccgtnnnnnnnnnnnnnnnnnnnnnnnnnnnnnnnnnnnnnnnnggttgcacacctttc

SEQ ID NO: 1521 - DNA, 30 bp, Artificial Sequence
  Description of Artificial Sequence:  Primer 1
cacttagcattaaccctcactaaaggccgt

SEQ ID NO: 1522 - DNA, 33 bp, Artificial Sequence
  Description of Artificial Sequence:  Primer 2
taatacgactcactataggaaaggtgtgcaacc

SEQ ID NO: 1523 - RNA, 23 nt, Artificial Sequence
  Description of Artificial Sequence:  Synthetic nucleic acid
gccguggguugcacaccuuuccc

SEQ ID NO: 1524 - DNA, 93 bp, Artificial Sequence
  Description of Artificial Sequence:  Template
  misc_feature (18)..(78): n stands for any a, c, g, or t
accctcactaaaggccgtnnnnnnnnnnnnnnnnnnnnnnnnnnnnnnnnnnnnnnnnnnnnnnnnnnnnnnnnnnnnggttgcacacctttc

SEQ ID NO: 1525 - DNA, 53 bp, Artificial Sequence
  Description of Artificial Sequence:  Template
  misc_feature (18)..(38): n stands for any a, c, g, or t
accctcactaaaggccgtnnnnnnnnnnnnnnnnnnnnggttgcacacctttc

SEQ ID NO: 1526 - DNA, 18 bp, Artificial Sequence
  Description of Artificial Sequence:  Primer
accctcactaaaggccgt

We claim:

1. An enzymatic nucleic acid molecule having formula II:

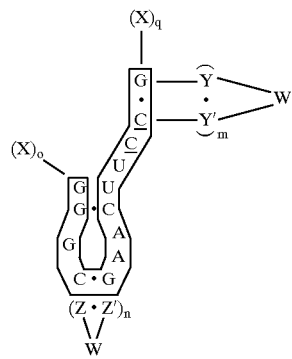

wherein each X, Y, and Z represents independently a nucleotide which may be the same or different; q is an integer ranging from 3 to 100; m is an integer ranging from 1 to 10; n is an integer ranging from 1 to 10; o is an integer ranging from 3 to 100; Z' is a nucleotide complementary to Z; Y' is a nucleotide complementary to Y; each X(q) and X(o) are oligonucleotides which are of sufficient length to stably interact independently with a target nucleic acid sequence; W is a linker ranging from 2 to 70 nucleotides; A, U, G, and C represent nucleotides; $\underline{C}$ is 2'-deoxy-2'-amino cytidine; and __ represents a chemical linkage.

2. An enzymatic nucleic acid molecule having formula III namely:

(SEQ ID NO: 1519)

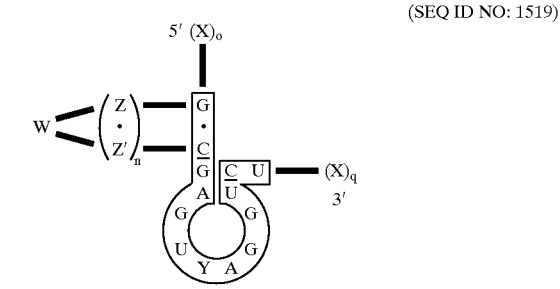

wherein each X, Y, and Z represents independently a nucleotide which may be the same or different; q is an integer ranging from 3 to 100; m is an integer ranging from 1 to 10; n is an integer ranging from 1–10; o is an integer ranging from 3–100; Z' is a nucleotide complementary to Z; Y' is a nucleotide complementary to Y; each X(q) and X(o) are oligonucleotides which are of sufficient length to stably interact independently with a target nucleic acid sequence; W is a linker ranging from 2 to 70 nucleotides; A, U, G, and C represent nucleotides; $\underline{C}$ 2'-deoxy-2'-aminocytidine; and __ represents a chemical linkage.

3. The enzymatic nucleic acid molecule of claim 2, wherein said nucleic acid molecule has an endonuclease activity to cleave RNA of a mammalian HER2 gene.

* * * * *